(12) United States Patent
Mitsch et al.

(10) Patent No.: US 8,936,910 B2
(45) Date of Patent: Jan. 20, 2015

(54) METHOD FOR SELECTIVE OLIGONUCLEOTIDE MODIFICATION

(75) Inventors: Andreas Mitsch, Lappersdorf-piehlmühle (DE); Karl-Hermann Schlingensiepen, Regensburg (DE); Bernd Betzler, Aalen (DE); Frank Jaschinski, Obertraubling (DE); Anneliese Schneider, Feldafing (DE)

(73) Assignee: Antisense Pharma GmbH, Regensburg (DE)

( * ) Notice: Subject to any disclaimer, the term of this patent is extended or adjusted under 35 U.S.C. 154(b) by 0 days.

(21) Appl. No.: 13/703,260

(22) PCT Filed: Jun. 10, 2011

(86) PCT No.: PCT/EP2011/059744
§ 371 (c)(1),
(2), (4) Date: Mar. 15, 2013

(87) PCT Pub. No.: WO2011/154542
PCT Pub. Date: Dec. 15, 2011

(65) Prior Publication Data
US 2013/0172238 A1 Jul. 4, 2013

(30) Foreign Application Priority Data
Jun. 11, 2010 (EP) .................................... 10165625

(51) Int. Cl.
*C12Q 1/68* (2006.01)
*C12N 15/11* (2006.01)
*C07H 21/02* (2006.01)

(52) U.S. Cl.
USPC .......................... 435/6.1; 536/23.1; 514/44 A

(58) Field of Classification Search
USPC .......................... 435/6.1; 536/23.1; 514/44 A
See application file for complete search history.

(56) References Cited

FOREIGN PATENT DOCUMENTS

| WO | 03/033701 A1 | 4/2003 |
| WO | 2008/077956 A2 | 7/2008 |
| WO | WO 2008077956 A2 * | 7/2008 |

OTHER PUBLICATIONS

Ficht et al., "Single-Nucleotide-Specific PNA—Peptide Ligation on Synthetic and PCR DNA templates" J. Am. Chem. Soc. 126:9970-9981 (2004).*
Zhao and Harris. Novel Degradable Poly(ethylene glycol) Esters for Drug Delivery. Chapter 28, Poly(ethylene glycol) (1997), pp. 458-472.
Chirila et al. The use of synthetic polymers for delivery of therapeutic antisense oligodeoxynucleotides. Biomaterials, vol. 23 (2002), pp. 321-342.

(Continued)

*Primary Examiner* — Jezia Riley
(74) *Attorney, Agent, or Firm* — Thompson Hine LLP

(57) ABSTRACT

Method for producing a modified oligonucleotide, wherein at least one polymer, preferably polyalkylene oxide, and/or a compound is covalently bound to the 5'-end or the 3'-end of the oligonucleotide via native ligation forming a native ligation site, with the proviso that the polymer and/or the compound is not a protein or peptide, if only the 5'-end of the oligonucleotide is modified by binding of the polymer or compound via native ligation. The invention is further directed to a modified oligonucleotide obtainable by the inventive method as well as the use of such modified oligonucleotide for the preparation of a medicament for preventing and/or treating a tumor, formation of metastasis, an immune disease or disorder, a cardiovascular disease or disorder, and/or a viral disease or disorder.

11 Claims, 21 Drawing Sheets

Conjugation of the 5'-end of Cysteine-modified Oligonucleotide via Native Ligation to of a modified oligonucleotide of SEQ ID No. 2030

(56) References Cited

OTHER PUBLICATIONS

Stetsenko et al. Peptide Conjugates of Oligonucleotides As Enhanced Antisense Agents. Molecular Biology, vol. 34, No. 6 (2000), pp. 852-859.

Stetsenko and Gait. New Phosphoramidite Reagents for the Synthesis of Oligonucleotides Containing a Cysteine Residue Useful in Peptide Conjugation. Nucleosides, Nucleotides & Nucleic Acids, vol. 19, No. 10-12 (2000), pp. 1751-1764.

Stetsenko and Gait. Efficient Conjugation of Peptides to Oligonucleotides by "Native Ligation." J. Org. Chem. vol. 65 (2000), pp. 4900-4908.

Pierce et al. Peptide-Oligonucleotides Hybrids in Antisense Therapy. Mini-Reviews in Medicinal Chemistry. vol. 5 (2005), pp. 41-55.

Dawson et al. Synthesis of Proteins by Native Chemical Ligation. Science, vol. 266 (1994), pp. 776-779.

PCT, International Search Report, PCT/EP2011/059744 (mailed Sep. 5, 2011), 3 pages.

Lu et al. Chemical Strategies for the Synthesis of Peptide—Oligonucleotide Conjugates. Bioconjugate Chem., vol. 21 (2010), pp. 187-202.

International Preliminary Report on Patentability for PCT/EP2011/059744 (issued Dec. 14, 2012), 6 pages.

* cited by examiner

FIG. 1-1

| Target | SEQ ID NO | Sequences |
|---|---|---|
| TGF-beta 2 | 2030 | cggcatgtctatttgta |
| | 2031 | gctttcaccaaattggaagc |
| | 2032 | ctggctttgggtt |
| | 2033 | cacacagtagtgca |
| | 2034 | gcacacagtagtgc |
| | 2035 | gcttgctcaggatctgc |
| | 2036 | tactcttcgtcgct |
| | 2037 | cttggcgtagtact |
| | 2038 | gtaaacctccttgg |
| | 2039 | gtctatttgtaaacctcc |
| | 2040 | gcatgtctatttgtaaacc |
| | 2041 | ggcatcaaggtacc |
| | 2042 | ctgtagaaagtggg |
| | 2043 | acaattctgaagtagggt |
| | 2044 | tcaccaaattggaagcat |
| | 2045 | tctgatatagctcaatcc |
| | 2046 | tcctagtggactttatag |
| | 2047 | tttttcctagtggact |
| | 2048 | caattatctgcacatttc |
| | 2049 | gcaattatctgcaca |
| | 2050 | gcagcaattatctgc |
| | 2051 | tggcattgtaccct |
| | 2052 | tgtgctgagtgtct |
| | 2053 | cctgctgtgctgagtg |
| | 2054 | ctgggtgtttgc |
| | 2055 | tttagctgcattgcaag |
| | 2056 | gccactttccaag |
| TGF-beta 1 | 2057 | ctgatgtgttgaagaaca |
| | 2058 | cgatagtcttgcag |
| | 2059 | gtcgatagtcttgc |
| | 2060 | cttggacaggatct |
| | 2061 | ccaggaattgttgc |
| | 2062 | cctcaattcccct |
| | 2063 | gatgtccacttgca |
| | 2064 | ctccaaatgtaggg |
| | 2065 | accttgctgtactg |
| | 2066 | gtagtacacgatgg |
| | 2067 | cacgtagtacacga |
| | 2068 | catgttggacagct |
| | 2069 | gcacgatcatgtt |
| | 2070 | tgtactctgcttgaac |
| | 2071 | ctctgatgtgttgaag |
| | 2072 | ggaagtcaatgtacag |
| | 2073 | catgtcgatagtcttgca |
| | 2074 | agctgaagcaatagttgg |
| | 2075 | gtcatagatttcgttgtg |
| | 2076 | ctccactttaacttgag |
| | 2077 | tgctgtattctggtaca |
| TGF-beta 3 | 2078 | tcgagcttccccca |
| | 2079 | ccccgagcccaagg |
| | 2080 | cccgacgagcccgg |
| | 2081 | acgcaccaaggcga |
| | 2082 | cgggttgtcgagccc |
| | 2083 | cggcagtgcccg |
| | 2084 | cgcaattctgctcg |
| | 2085 | ttcgttgtgctccc |
| | 2086 | attccgactcggtg |
| | 2087 | acgtgcgtcatcaccgt |
| | 2088 | ccaagaagcc |
| | 2089 | cctaatgcttcca |
| | 2090 | tcagcagggcagg |
| | 2091 | gcaaagttcagcagggc |
| | 2092 | ggcaaagttcagcagg |
| | 2093 | gtggcaaagttcagcagg |
| | 2094 | gtggcaaagttcag |
| | 2095 | gaccgtggcaaagttcag |
| | 2096 | agagaggctgaccgt |
| | 2097 | gagagagagaggctgac |
| | 2098 | acagagagaggctga |
| | 2099 | gtggacagagagagg |
| | 2100 | caactggacagagagagg |
| | 2101 | tcttcttgatgtggcc |
| | 2102 | ccctcttcttgatg |
| | 2103 | caccctctctcttct |
| | 2104 | atggattctttggcat |
| | 2105 | ggattctttggc |
| | 2106 | aagttggactctcttctc |
| | 2107 | taagttggactctcttct |
| PGE-rec. | 2108 | taggagtggttgaggc |
| | 2109 | gtgtaggagtggtgag |
| | 2110 | ctgtgtaggagtgg |
| | 2111 | cccacatgcctgtg |
| | 2112 | cgatgaacaacgag |
| | 2113 | ctggcgatgaacaacg |
| | 2114 | cgctggcgatgaac |
| | 2115 | gagctagtcccgttg |
| | 2116 | gcgaagagctagtcc |
| | 2117 | ccagtatgcgaagagc |
| | 2118 | ccccagttatgcgaag |
| VEGF | 2119 | cggccgcggtgtgt |
| | 2120 | cgggaatgcttccgccg |
| | 2121 | cggctcaccgcctcggc |
| | 2122 | cacgtctgcggatc |
| | 2123 | ccccgcatcgcatcaggg |

FIG. 1-2

IL-10
- 2124 cgccttgcaacgcg
- 2125 ccgaccggggccgg
- 2126 gtcatggtttcgg
- 2127 gcagaaagttcatgg
- 2128 gctgatagacatcc
- 2129 gcgctgatagacat
- 2130 gtagctgcgctgatag
- 2131 ctcgatctcatcag
- 2132 atgtactcgatctcatc
- 2133 gaagatgtactcgatc
- 2134 ctgaagatgtactcg
- 2135 gcatcgcatcaggg
- 2136 ccgcatcgcatcag
- 2137 cattgttgtgctgtagg
- 2138 ggtctgcattcacattg
- 2139 ctttggtctgcattc
- 2140 cttcttggtctgc
- 2141 gctctatctttcttgg
- 2142 gtctgctctatcttc
- 2143 cttgtcttgctctatc
- 2144 catctgcaagtacgttcg
- 2145 cacatctgcaagtacgtt
- 2146 gtcacatctgcaagtacg
- 2147 catctgcaagtacg
- 2148 cacatctgcaagtac
- 2149 gtcacatctgcaag
- 2150 cttgtcacatctgc
- 2151 ggcttgtcacatctgc
- 2152 ctcggcttgtcacatc
- 2153 ctccttcctcctgc
- 2154 gctgaagatgtacctcg
- 2155 cgttgctctccgacg
- 2156 cttctttgcaagtctgt
- 2157 tgagctgtgcatgcctc
- 2158 agtcaggaggaccag
- 2159 tgggtgccctggcct
- 2160 catgttaggcaggtt
- 2161 aggcatctggagatct
- 2162 aaagtcttcactctgc
- 2163 aacaagttgtccagctg
- 2164 gtaaaactggatcatctc
- 2165 catcacctcctccag
- 2166 gggtcttcaggttctccc
- 2167 cacggccttgctcttgtt
- 2168 ttattaaaggcattcttc
- 2169 aagatgtcaaactcactc
- 2170 gtagttgatgaagatgtc
- 2171 gattttggagaccctct
- 2172 tcagctatcccagagc c-erbb2
- 2173 ggctgggtcagctat
- 2174 aaatcgttcacagagaag
- 2175 tctttctaaatcgttcac
- 2176 ttcatgtctgtgcc
- 2177 gtaggtgagttcca
- 2178 gttgtgagcgatga
- 2179 catagttgtcctcaaaga
- 2180 ggcatagttgtcct
- 2181 cattgtctagcacg
- 2182 ctccattgtctagc
- 2183 gtattgttcagcgg
- 2184 tcaagatctctgtgag
- 2185 cacaaaatctgtgtcct
- 2186 tccttccacaaaatcg
- 2187 gtggaagatgtcct
- 2188 tcttgtggaagatgtc
- 2189 tctatcagtgtgagag
- 2190 ggttggtgtctatc
- 2191 acatcggagaacag
- 2192 ccttacacatcgga
- 2193 acaatcctcagaactc
- 2194 gctctgacaatcct
- 2195 tggttgaagtggag
- 2196 ctgtggttgaagtg
- 2197 gttgtaggtgacca
- 2198 ctgtgttgtaggtg
- 2199 gactcaaacgtgtc
- 2200 catggactcaaacg
- 2201 cgaatgtataccgg
- 2202 ccgaatgtataccg
- 2203 gccgaatgtatacc
- 2204 gtagttgtagggac
- 2205 tagaaaggtagttgtagg
- 2206 gtagaaaggtagttgtag
- 2207 cgtagaaaggtagttg
- 2208 ccgtagaaaggtag
- 2209 gaccatagcacact
- 2210 ggatattggcactg
- 2211 cctggatattggca
- 2212 gctcccaaagatct
- 2213 cccatcaaagctct
- 2214 caaaacacttggagc
- 2215 gtctcaaacacttgga
- 2216 gagtctcaaacacttg
- 2217 gtaacctgtgatctct
- 2218 ggtaacctgtgatc
- 2219 gtataggtaacctgtg
- 2220 tgagatgtataggtaacc
- 2221 tgctgagatgtatagg

FIG. 1-3

2222 ccatgctgagatgt
2223 ggattacttgcagg
2224 tgttatggtggatgag
2225 ggtgttatggtgga
2226 gcagttgacacact
2227 agtactcggcattc
2228 cattcacatactccct
2229 tccaaaacaggtcact
2230 ggtccttatagtgg
2231 cagaatgccaacca
2232 acgagaatgccaac
2233 gatcccaaagacca     c-jun
2234 tcgcttgatgagga
2235 catcgtgtacttcc
2236 gcatcgtgtacttc
2237 actgtgccaaaagc
2238 cttgtagactgtgc
2239 ccctgtagactgt
2240 tcaacactttgatggc
2241 ccctcaacactttg
2242 gtgtttccctcaaca
2243 gtatgcttcgtctaag
2244 cgtatgcttcgtct
2245 ccatcacgtatgct
2246 gcataagctgtgtc
2247 catggtctaagagg
2248 caatctgcatcacce
2249 ggcaatctgcatac
2250 ctgtctcgtcaatg
2251 cataactccacacatc
2252 agtcacaccataactc
2253 acagtcacaccataac
2254 ccccaaaagtcatc
2255 tcgtaaggtttggc
2256 gatcccatcgtaag
2257 caatggtgcagatg
2258 gacatcaatggtgc
2259 gtagacatcaatggtg
2260 catgatcatgtagacatc
2261 ccatgatcatgtagac
2262 catttgaccatgatcatg
2263 ccaacatttgaccatg
2264 tcatccaacatttgacca
2265 gagtcaatcatccaacat
2266 cagagtcaatcatcca
2267 ccgacattcagagt
2268 gaattcagacaccaac
2269 gatgaccacaaagc
2270 ccatcaaatacatcgg 2271 tcaccatcaaatacatcg
2272 caacgtagccatca
2273 acgtctttgacgac
2274 caaaaacgtctttgacga
2275 ggcaaaaacgtctttg
2276 caaaggcaaaaacgtc
2277 gtgtcaagtactcg
2278 gtaatagaggttgtcg
2279 cccagtaatagagg
2280 catggtgctcactg
2281 gtgcctgtacgtac
2282 tcggactatactgc
2283 cagttcggactatact
2284 aagcctaagacgca
2285 gcccaagtcaaaca
2286 tgaaaagtcgcggt
2287 ggttaattaagatgcctc
2288 tctctaagagcgca
2289 acgtgaggttagttg
2290 cacgtgaggttagt
2291 catagaacagtccg
2292 cagtcatagaacagtc
2293 ctttgcagtcatagaaca
2294 tgcagtcatagaac
2295 ggtcgttccatct
2296 catagaaggtcgttc
2297 cgtcatagaaggtc
2298 catcgtcatagaagg
2299 ggacgggaggaacgaggcgttgag
2300 tagccataaggtcc
2301 ggttactgtagcca
2302 ggttactgtagcca
2303 cagggtcatgctctgttcaggatcttggg
2304 agttcttggcgcggaggt
2305 aggtgaggaggtccgagt
2306 tggactggattatcag
2307 gtggtggtgatgtgcccg
2308 tgtcacgttcttgg
2309 ctcatctgtcacgt
2310 cgaagccctcggcgaacc
2311 gcgtgttctggctgtgcagttcgg
2312 ctgccccgttgacc
2313 aggtttgcgtagac
2314 ggttgaagttgctg
2315 ctgggttgaagttg
2316 tgctggggttgcgcgggaaaggcc
2317 tgctgcacgggcatctgctg
2318 ggcactgtctgaggctcctccttcagg
2319 actccatgtcgatg

FIG. 1-4 c-fos
2320 ctctccgcctigatcc
2321 gttcctcatgcgcttc
2322 ctgagcttcaagg
2323 gcgattctctccagcttccttttcg
2324 ctgagcttcaaggttttcactttttcctc
2325 tccctgagcatgtt
2326 tctgttaagctgtgc
2327 cttttctgtttaagctgtg
2328 ggttcatgacttctg
2329 cgtggtcatgact
2330 actgttaacgtggttc
2331 ccactgttaacgtg
2332 cccactgttaacgt
2333 agcatgagttggca
2334 gcgttagcatgagt
2335 gtttgcaactgctg
2336 caaaatgtttgcaactgc
2337 tcgtagaaggtcgt
2338 agggttactgtagc
2339 gtagtggtgatgtg
2340 cgtcgtagaaggtc
2341 cgagaacatcatcg
2342 gtagtctgcgttga
2343 gctgcagcgggaggatgacg
2344 agtaagagaggctatc
2345 gtagtaagagaggc
2346 ggtagtaagagagg
2347 gtgagtggtagtaaga
2348 gtccgtgcagaagtcctg
2349 gaatgaagttggcact
2350 ggaatgaagttggc
2351 gggaatgaagttgg
2352 gctgcaccagccactgcaggtccggactgg
2353 ctggtctgcgatggggccacagaggagacg
2354 tcatggtcttcacaac
2355 caatgctctgcgctcggcctcctgtcatgg
2356 ctagagttcctcac
2357 gagtacgctagagt
2358 gaagagtacgctag
2359 ctgcttcccacccagccccccacattccc
2360 ttcatcctctgtactgggct
2361 gttacggatgtgca
2362 cagttacggatgtg
2363 ccagttacggatgt
2364 agagtctgagttgg
2365 gtgagactcagagt
2366 tcttagggtgagac
2367 agagtacttcttagg
2368 ggaagaaactatgagagt 2369 cttagggaagaaactatg
2370 cggtaagaaacttagg
2371 agcatgcggtaaga
2372 gtctgaaagcatgc
2373 agaacaaagaagagcc
2374 caagagaacaaagaagag
2375 cagcaagagaacaaag
2376 tcctcagcaagaga
2377 aggtgtgacttgca
2378 gaataggtgtgactg
2379 cagaataggtgtgact
2380 gcagaataggtgtg
2381 cagttgcagaataggt
2382 gaaaccatttctgacc
2383 tgtgaaaccatttctgac
2384 cactgtgaaaccattct
2385 ccactgtgaaacca
2386 agaactggctcctgcagcttcctgcttcc
2387 cacctccattcaccc
2388 cagtaaaagtgtctgc
2389 cgacattcagtaaaagtg
2390 gaccgacattcagt
2391 cttctggagataactaga
2392 catcttattcctttccct
2393 cagccatcttattcct
2394 tgcagccatcttattc
2395 gagtgtatcagtcag
2396 ggagtgtatcagtc
2397 cttggagtgtatcagt
2398 acagagtacctacc
2399 ccaactttcccttaag
2400 ccttatgctcaatctc
2401 gtcttactcaaggg
2402 acagtcttactcaagg
2403 cataagacacagtcttac
2404 gaaagcataagacacagt
2405 ggaaagcataagacac
2406 agggataaaggaaagc
2407 cctgtatacagagg
2408 tgtctcctgtatacag
2409 catctctagttggtc
2410 ctcatcttctagttgg
2411 cttctcatcttctagttg
2412 caaagcagactctca
2413 ctgcaaagcagact
2414 ctagtttttccttctcct
2415 tctagtttttccttctcc
2416 caggatgaactctagt
2417 cgagaacatcatgg

FIG. 1-5

MIA
- 2418 gtagtaggaaaggc
- 2419 ggtagtaggaaagg
- 2420 ggaatggtagtagg
- 2421 ggtcattgagaagag
- 2422 gctaatgttcttgacc
- 2423 gtcaggaatcggcag
- 2424 ctggagaagacatac
- 2425 tgcctcccagaag
- 2426 cactggcagtagaaatc
- 2427 gctcactggcagtag
- 2428 atggtcaggaatcg
- 2429 gaatggtcaggaatcg
- 2430 catcgtggactgtg
- 2431 agccatggagatag
- 2432 cagccatggagatag
- 2433 acagccatggagatag
- 2434 cacagccatggagatag
- 2435 ccacagccatggagat
- 2436 gccatggagatagg
- 2437 agccatggagatagg
- 2438 cagccatggagatagg
- 2439 acagccatggagatagg
- 2440 catggagatagggt
- 2441 catggagatagggtg
- 2442 catggagatagggtgg
- 2443 atggagatagggtg
- 2444 atggagatagggtgg
- 2445 atggagatagggtggc
- 2446 atggagatagggtggct
- 2447 ggagatagggtggc
- 2448 ggagatagggtggct
- 2449 gaaatagcccaggc
- 2450 gaaatagcccaggcg
- 2451 gaaatagcccaggcgag
- 2452 ggaaatagcccagg
- 2453 ggaaatagcccaggc
- 2454 gtcttcacatcgac
- 2455 gtcttcacatcgact
- 2456 gtcttcacatcgactt
- 2457 gtcttcacatcgacttt
- 2458 gtcttcacatcgactttg
- 2459 gtcttcacatcgactttg
- 2460 ccatttgtctgtcttcac
- 2461 attaccgtctaccctgat

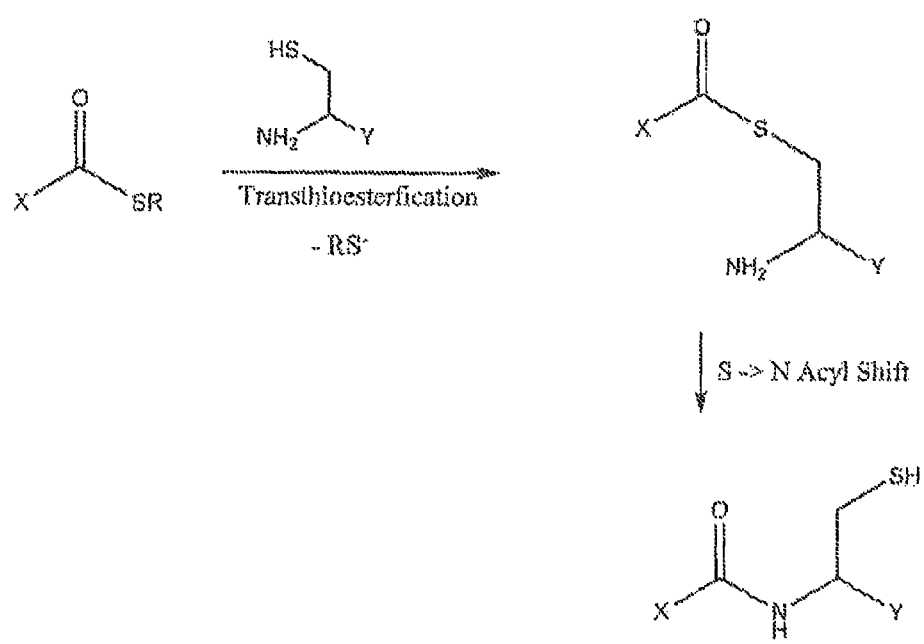
Figure 2: General Reaction Mechanism of Native Ligation

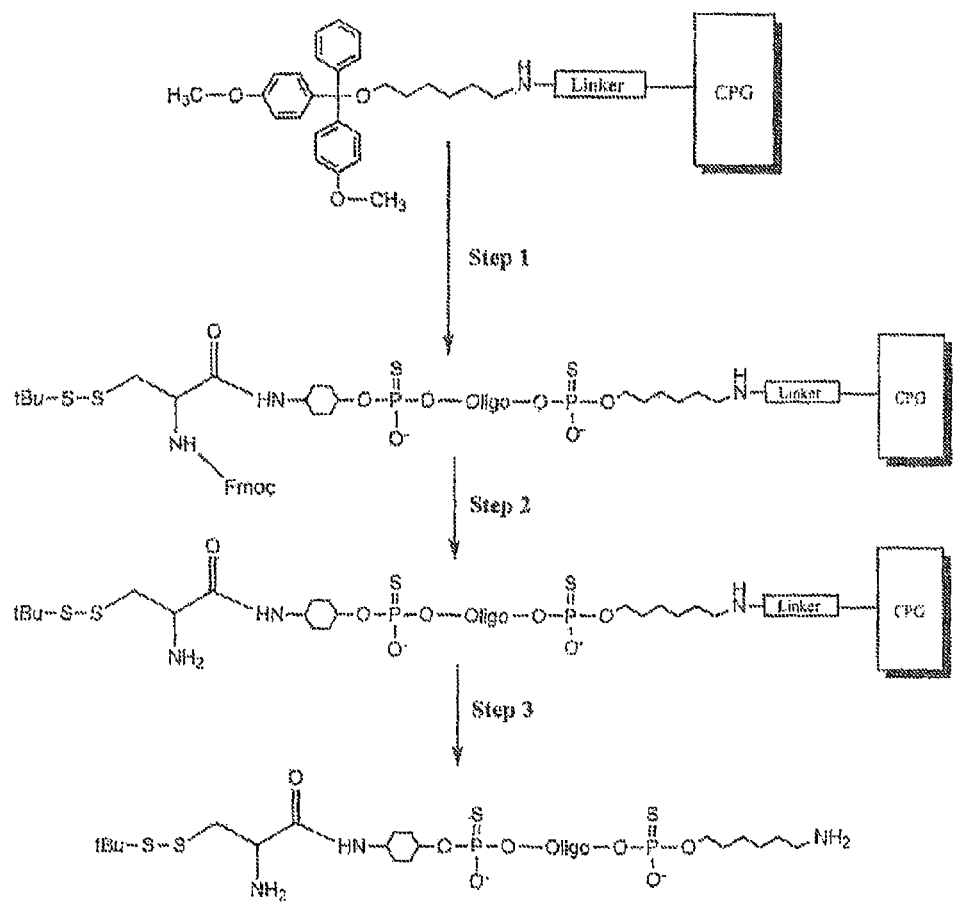
Fig. 3: 5'Cys-Oligo-Synthesis

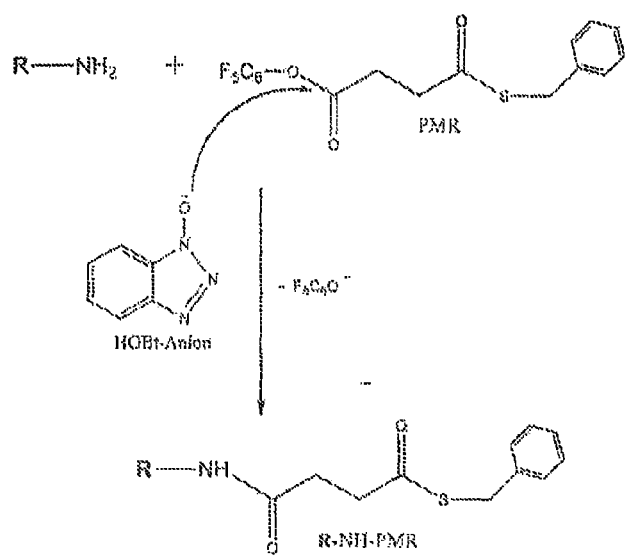
Fig. 4: General Thioestermodification of Amin-containing Compounds for native ligation

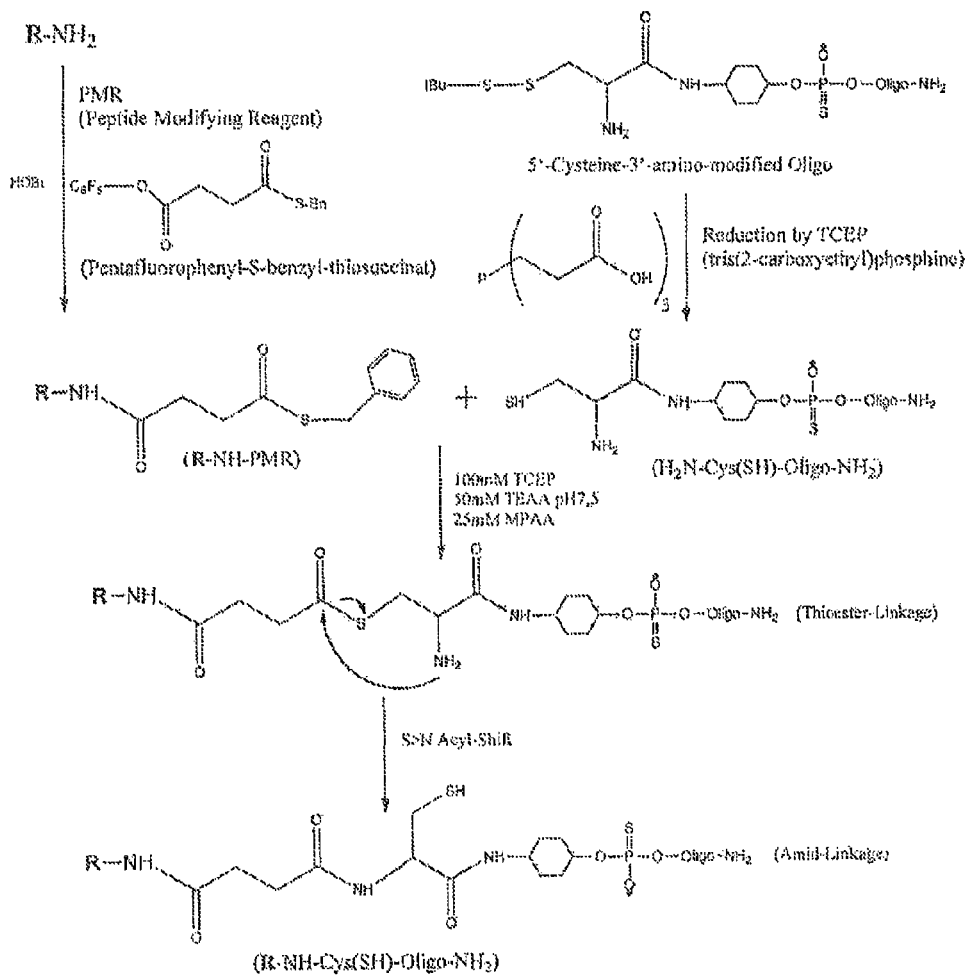
Fig. 5: Conjugation of the 5'-end of Cysteine-modified Oligonucleotide via Native Ligation te of a modified oligonucleotide of SEQ ID No. 2030

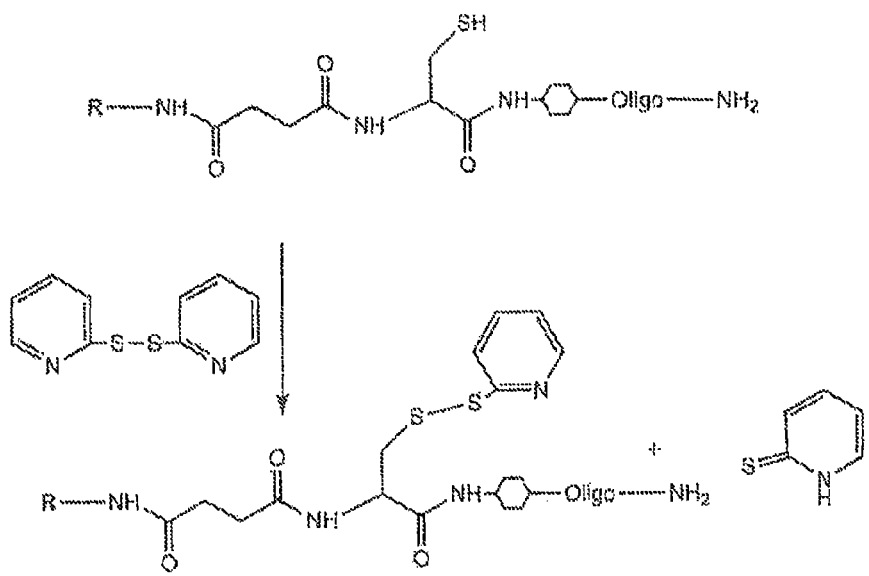
Fig. 6: Protection/Activation of the remaining Thiolfunction of the cysteine-residue after Native Ligation
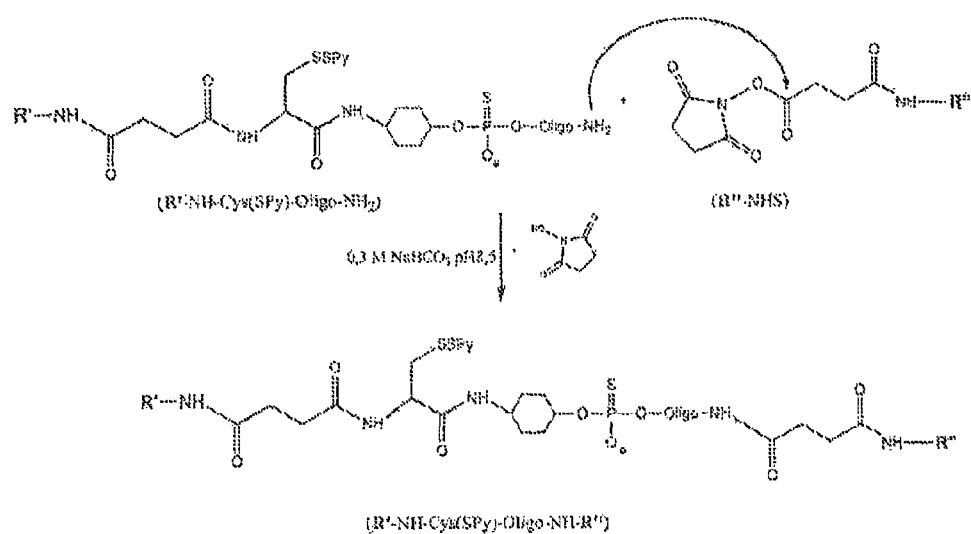
Fig. 7: Conjugation of the 3'-end of a 5'-conjugated Oligonucleotide by NHS ester

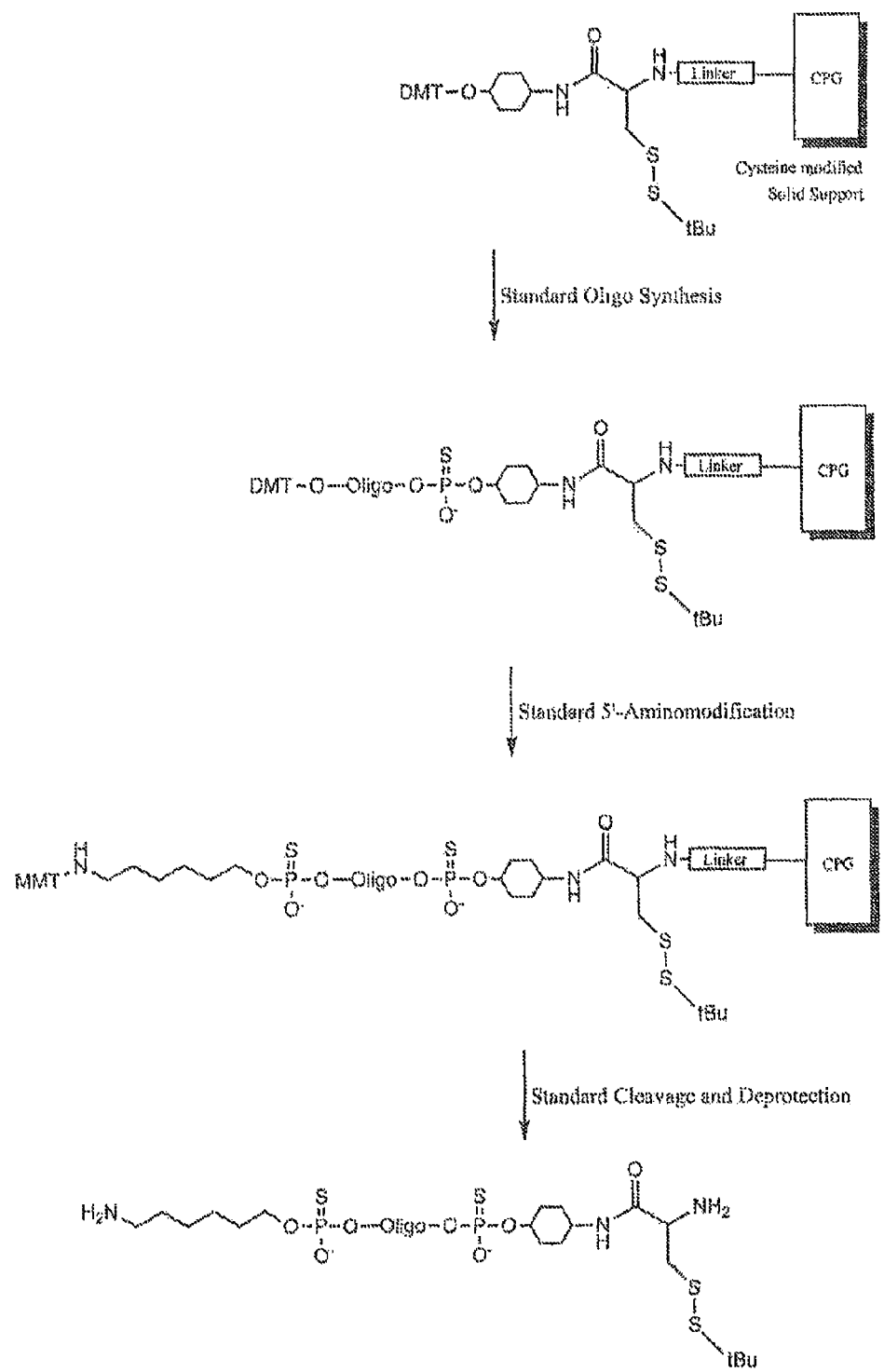
Fig. 8: 3'-Cys-Oligo-Synthesis

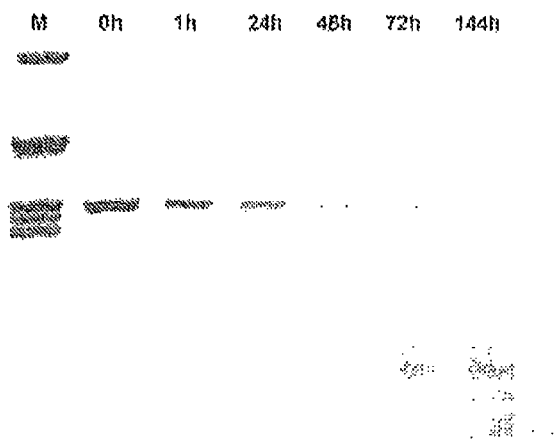
Fig. 9a: Unmodified oligonucleotide incubated with S1 endonuclease according to the indicated times
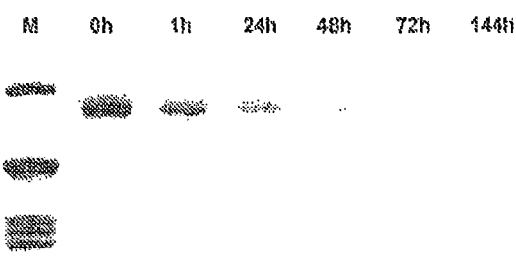
Fig. 9b: PEG-modified oligonucleotide (mPEG400-Oligo-mPEG1000) incubated with S1 endonuclease according to the indicated times

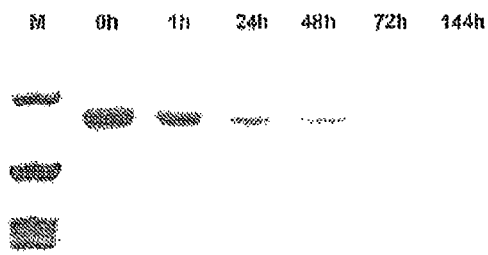
Fig. 9c: PEG-modified oligonucleotide (mPEG1000-Oligo-mPEG400) incubated with S1 endonuclease according to the indicated times
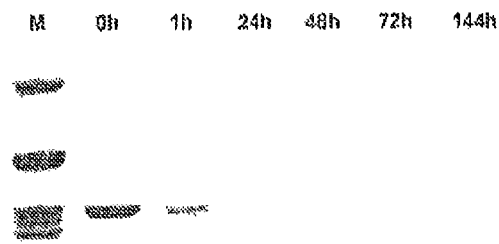
Fig. 10a: Unmodified oligonucleotide incubated with 5'exonuclease according to the indicated times

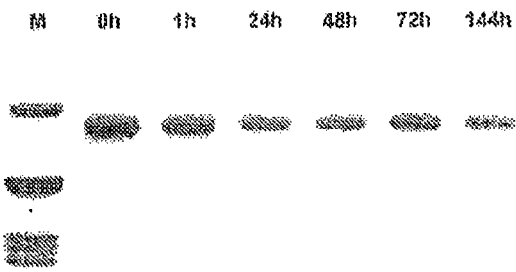
Fig. 10b: PEG-modified oligonucleotide (mPEG400-Oligo-mPEG1000) incubated with 5'exonuclease according to the indicated times
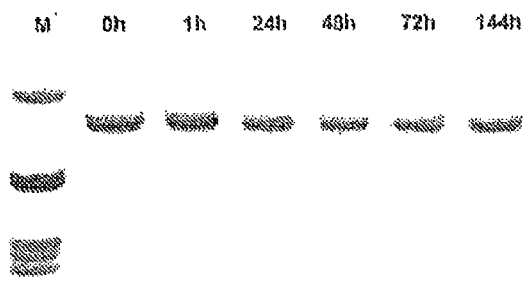
Fig. 10c: PEG-modified oligonucleotide (mPEG1000-Oligo-mPEG400) incubated with 5'exonuclease according to the indicated times

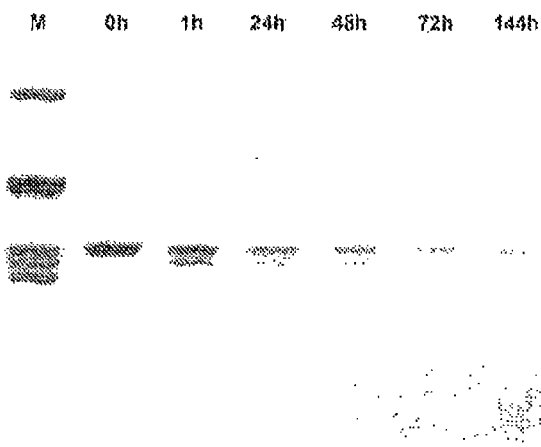
Fig. 11a: Unmodified oligonucleotide incubated with 3′exonuclease according to the indicated times
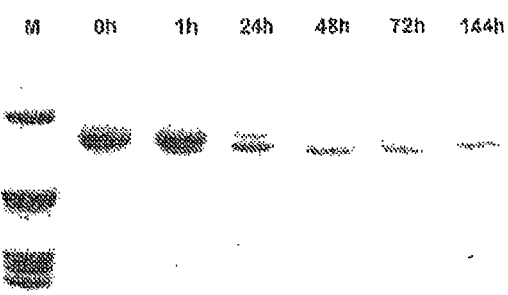
Fig. 11b: PEG-modified oligonucleotide (mPEG400-Oligo-mPEG1000) incubated with 3′exonuclease according to the indicated times

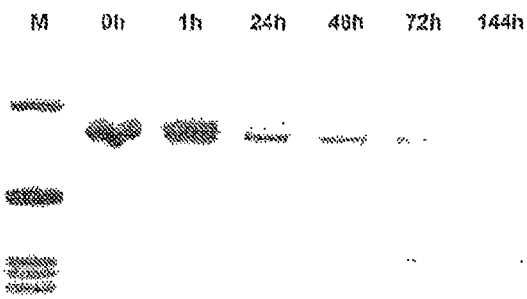
Fig. 11c: PEG-modified oligonucleotide (mPEG1000-Oligo-mPEG400) incubated with 3´ exonuclease according to the indicated times
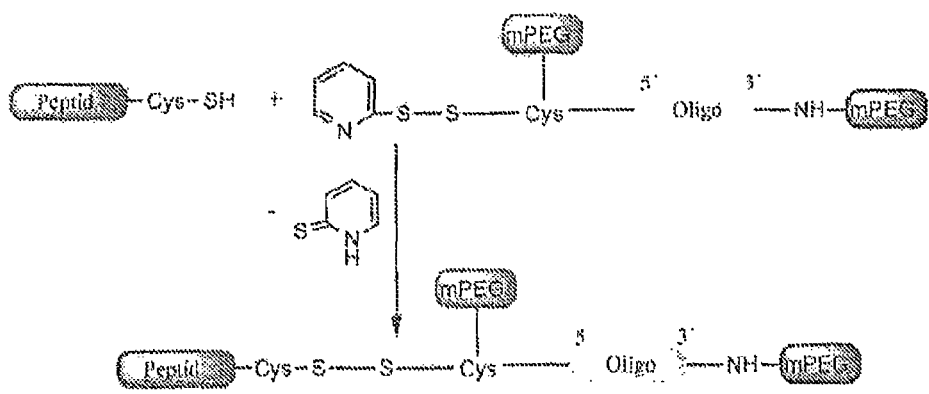
Fig. 12: Schematic presentation of the binding of an activated peptide to the native ligation site of a modified oligonucleotide

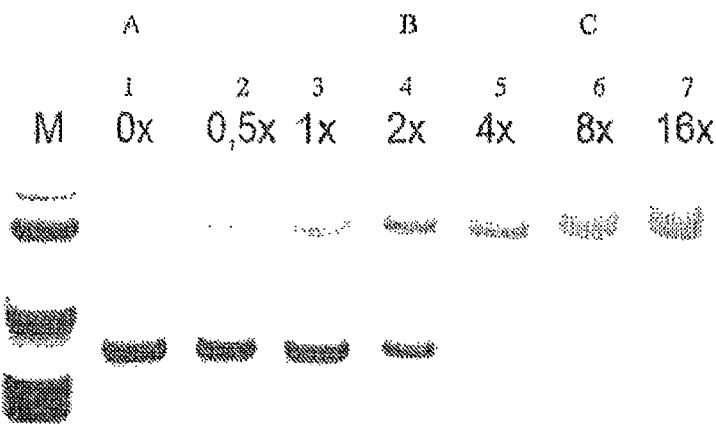
Fig. 13A: Silver stained PAGE gel showing educts and the product of the binding of penetratin to the native ligation site of a modified oligonucleotide of SEQ ID No. 2461
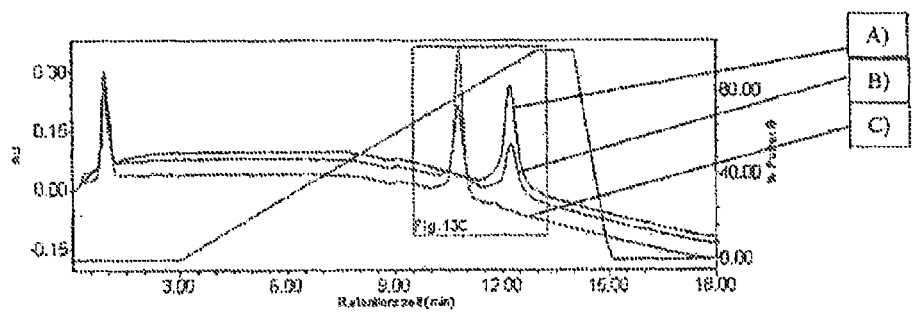
Fig. 13B: Chromatogram showing educts and products of silver stained PAGE indicated as lines A, B, and C in Fig. 13A
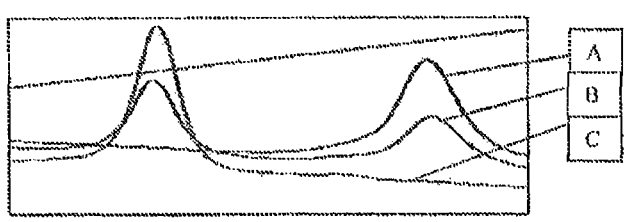
Fig. 13C: Detailed presentation of lines A, B and C of Fig. 13B

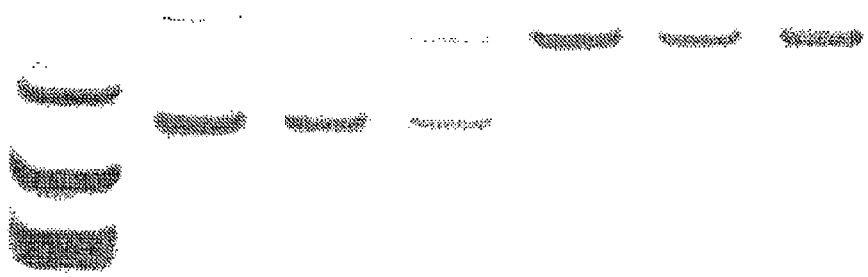
Fig. 14A: Silver stained PAGE gel showing educts and the product of the binding of penetratin to the native ligation site of a modified oligonucleotide of SEQ ID No. 2030
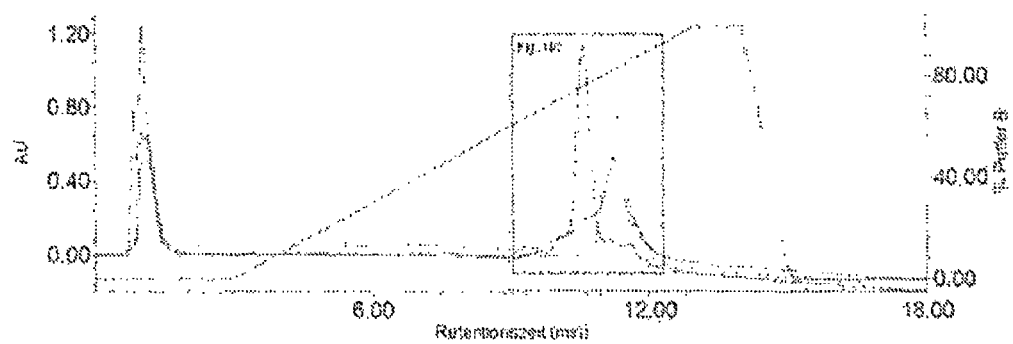
Fig. 14B: Chromatogram showing educts and products of silver stained PAGE indicated as lines A, B, C and D in Fig. 14A
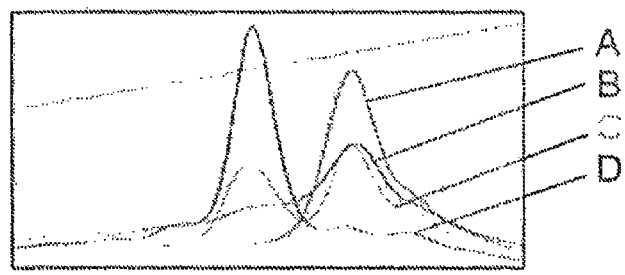
Fig. 14C: Detailed presentation of lines A, B, C and D of Fig. 14B

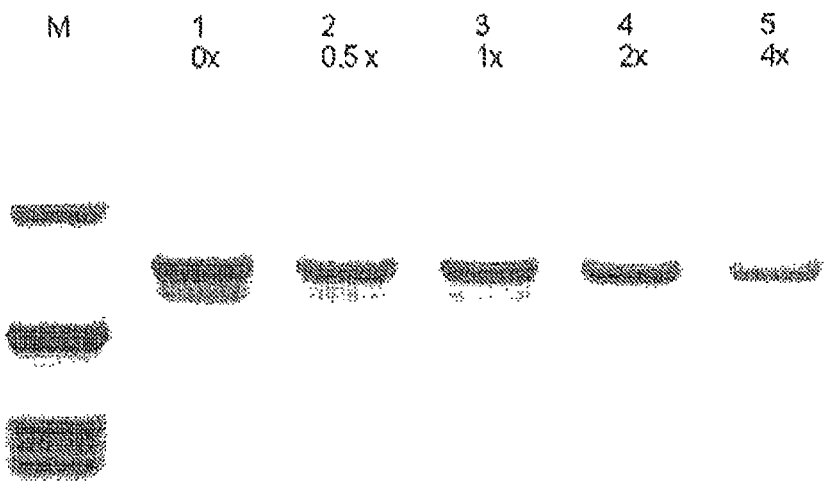
Fig. 15: Silver stained PAGE gel showing an experiment for coupling of penetratin to the native ligation site of a modified oligonucleotide of SEQ ID No. 2030 comprising an inaccessible native ligation site
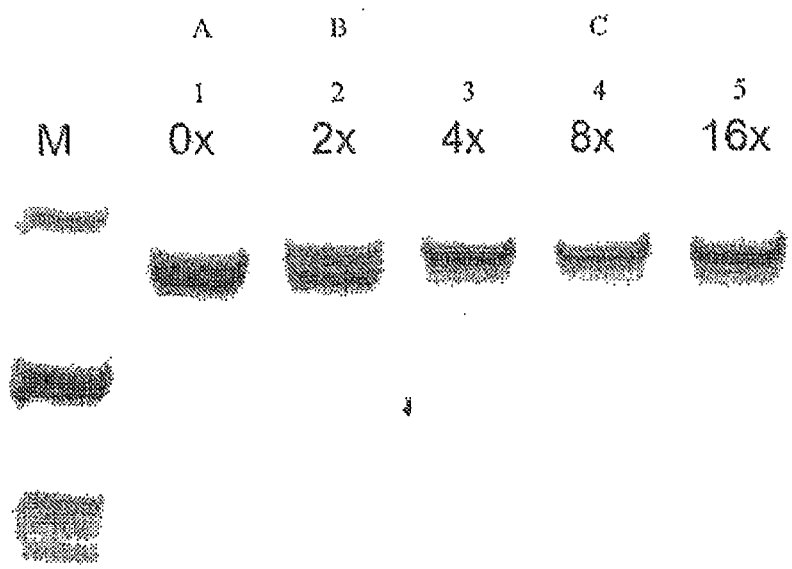
Fig. 16A: Silver stained PAGE gel showing educts and the product of the binding of RGDC peptide to the native ligation site of a modified oligonucleotide of SEQ ID No. 2030

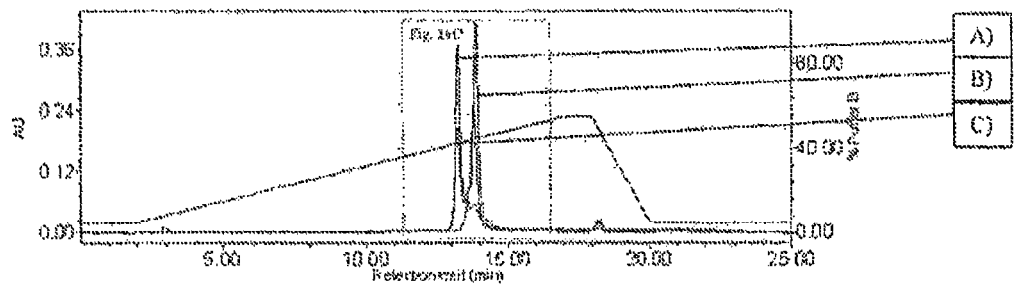
Fig. 16B: Chromatogram showing educts and products of silver stained PAGE indicated as lines A, B, and C in Fig. 16A
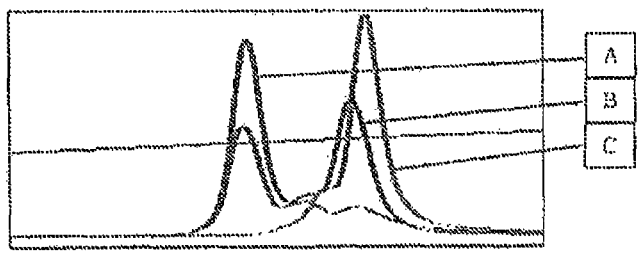
Fig. 16C: Detailed presentation of lines A, B and C of Fig. 16B
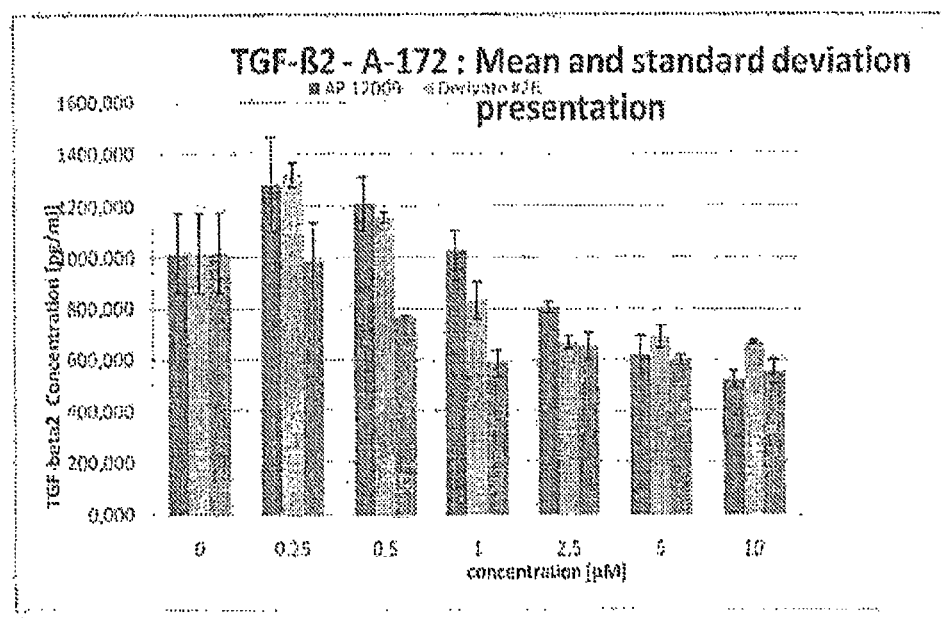
Fig. 17A: TGF-ß2 inhibition of glioma cells in contact with 5'-/3'-end PEG-modified oligonucleotide of SQ ID No. 2030 connected to RGD at the native ligation site

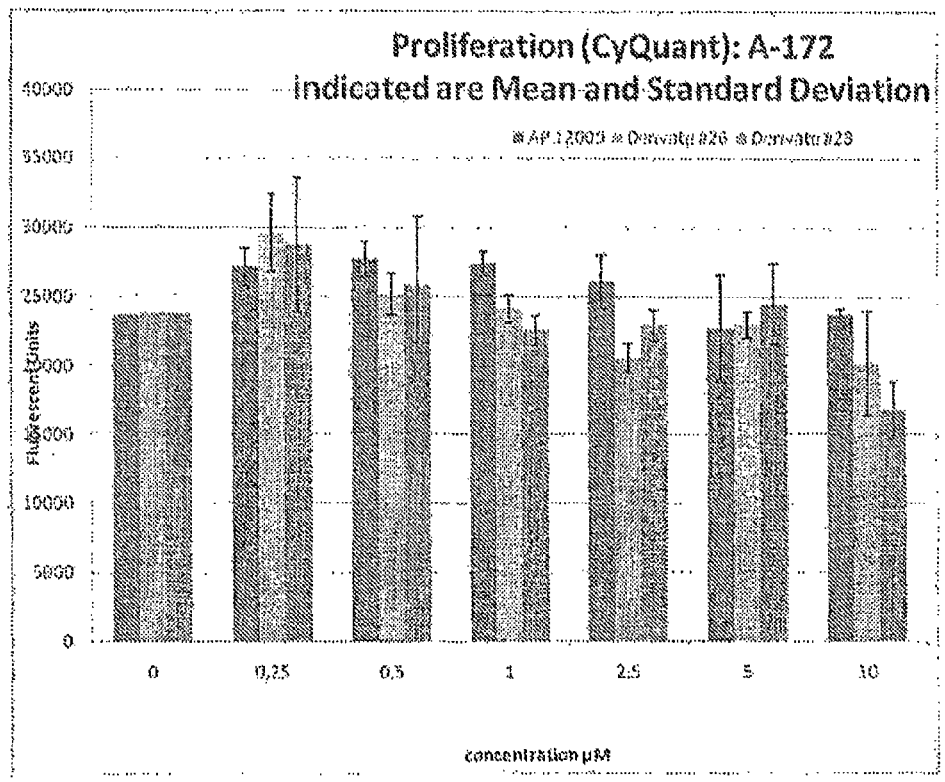
Fig. 17B: Proliferation of glioma cells in contact with 5'-/3'-end PEG-modified oligonucleotide of SEQ ID No. 2030 connected to RGD at the native ligation site
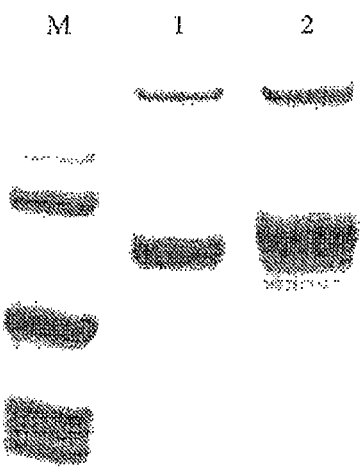
Fig. 18: Silver stained PAGE gel showing educt and the product of the binding of Fluorescein to the native ligation site of a modified oligonucleotide of SEQ ID No. 2030

METHOD FOR SELECTIVE OLIGONUCLEOTIDE MODIFICATION

RELATED APPLICATIONS

This application is a National Phase of co-pending International Application No. PCT/EP2011/059744 filed Jun. 10, 2011, which claims priority to European Patent Application No. 10165625.4, filed Jun. 11, 2010.

The present invention is directed to a method for selectively modifying an oligonucleotide, preferably an antisense oligonucleotide, wherein a polymer, in particular a polyalkylene oxide and/or a compound is covalently bound to the 3'- and/or 5'-end of the oligonucleotide, wherein the 5'- or the 3'-end is modified via native ligation forming a native ligation site, and optionally a further polymer and/or compound is bound, preferably to a cysteine residue at the native ligation site of the oligonucleotide conjugate.

Nonimmunogenic and water-soluble polymers have been widely used in biomaterial, biotechnology and medicine (Zhao 1997). In the area of drug delivery, polymer derivatives have been widely used in covalent attachment to proteins for example to reduce immunogenicity (Chirila 2001), proteolysis, kidney clearance and to enhance solubility. Polyethyleneglycol (PEG) for example is a widely used polymer that has been attached to more or less hydrophobic drugs to enhance solubility, reduce toxicity and alter biodistribution. A further aim of linking polymers like polyethyleneglycol to drugs is to enlarge the molecular weight and increase the body halflife time of the drug. In addition, a polymer is suitable as carrier in a pharmaceutical composition or is linked covalently to a drug to enhance cellular uptake and/or to direct the oligonucleotide to a target. Hence, polymers bound to an active agent often result in enhanced penetration and retention of the active agent in a cell or body system, and allow for example directing the agent specifically to a tumor, tumor tissue, or metastasis (targeting) to increase the success of a therapy.

WO 2008/077965 A2 describes oligonucleotide conjugates, wherein an oligonucleotide is connected to a polymer, preferably a polyethylenglycol. These conjugates are produced based on oligonucleotide synthesis, wherein 3'→5' synthesis and 5'→3' synthesis of the oligonucleotide on solid support are varied depending on the type and/or molecular size of the polymer, which is conjugated with the oligonucleotide.

Dawson et al. (Science 1994) originally described native ligation as a method for coupling unprotected polypeptides and/or proteins, respectively, to construct a large polypeptide or protein. Later native ligation was adapted to the coupling of peptides and oligonucleotides resulting for example in peptide-oligonucleotide hybrids, wherein the peptide is bound to the 5'-end of the oligonucleotide (Stetsenko D A et al., 2000; Pierce T L et al., 2005).

It is an object of the present invention to provide a method allowing multiple specific modification(s) of an oligonucleotide in a broad range with a polymer, which is preferably not a peptide or protein if it is bound to the 5'-end of the oligonucleotide using native ligation, and optionally further modification of the oligonucleotide with a compound, wherein the polymer and/or the compound is bound to the 3'-, and/or 5'-end of the oligonucleotide, and/or to the cysteine residue of the native ligation site forming an oligonucleotide conjugate of the invention. Due to the mild reaction conditions, in particular of the native ligation, of the present invention, the method is very efficient, characterized by a very low number of unwanted side products, and the products prepared by this method can easily be used for clinical administration. Moreover, the present method provides the platform for a high variety of conjugates with different polymers and/or compounds at different positions of the oligonucleotide.

Accordingly, it is a further object of the present invention to provide an oligonucleotide conjugate according to the inventive method.

Furthermore, it is an object of the present invention to use the oligonucleotide conjugate of the present invention for the preparation of a medicament for the prophylaxis and/or treatment of a disease, wherein the oligonucleotide of the conjugate hybridizes or interacts with a factor involved in the disease.

SUMMARY

The present invention refers to a method for highly selective modification of an oligonucleotide, preferably an antisense olignucleotide, wherein the 5'- or the 3'-end of the oligonucleotide is modified via native ligation. The oligonucleotide is further modified at the 3'-end, and/or at the 5'-end, and/or at a cysteine residue of the native ligation site. The modification of the oligonucleotide is preferably based on the binding of a polymer and/or a compound to the oligonucleotide at the 5'-, 3'-end of the oligonucleotide and/or at the thiol function of the cysteine residue, i.e., the native ligation site. In one embodiment, the 5'- and the 3'-end are modified via native ligation, wherein the 5'- or 3'-end is modified first, or both ends are modified in parallel. In case of the 5'- and 3'-end modification of the oligonucleotide via native ligation even two additional native ligation sites are created, which allow the combination with one or two additional polymers and/or compounds.

In a preferred embodiment, a polymer such as polyalkylene oxide for example a polyethylene glycol (PEG) is connected to the 5'- or to the 3'-end via native ligation with the cysteine residue at the native ligation site. This first step results in a conjugate comprising an oligonucleotide and a polymer. In a next step, a compound such as a small molecule, an antibody, an antigen, an enzyme, a part of an antibody, antigen or an enzyme, any peptide, e.g., an internalizing peptide, an aptamer, a chromophor, a marker, preferably a fluorescent marker like FITC, biotin, a hormone, a signal peptide, a lipid, a fatty acid, a sugar, an amino acid, a receptor, a part of a receptor, or any ligand of a receptor or binding molecule, or a polymer for example a polyalkylene oxide, is connected to the native ligation site, preferably to the cysteine residue of the conjugate. Alternatively, a polymer or a compound is connected to the 3'- or the 5'-end of the conjugate. In a further alternative embodiment, a polymer and/or a compound is connected to the native ligation site and to the 3'- or 5'-end of the oligonucleotide. The compound and/or the polymer is permanently bound to the oligonucleotide or is detached from the oligonucleotide, preferably if the modified oligonucleotide, i.e., the conjugate, reaches a target and the conjugate binds to the target. In a preferred embodiment, the protein and peptide, respectively, guides the oligonucleotide to the target, binds to the target and the oligonucleotide, preferably comprising further modifications (polymer and/or compound), is split off from the peptide or protein.

For example the combination of a modification of the 5'- or the 3'-end of an oligonucleotide via native ligation and the modification of the free 3'- or 5'-end using a linker such as an NHS-ester offers a surprisingly simple and reliable method for the production of symmetrically or asymmetrically modified oligonucleotides for example a polyalkylated oligonucleotide, preferably a pegylated oligonucleotide. A further advantage of the method is the formation of an additional functional group at the cysteine residue, which allows a further modification of the modified oligonucleotide for example with a further polymer, a small molecule, an antibody, an antigen, an enzyme, a part of an antibody, or an enzyme, any peptide, e.g., an internalizing peptide, an aptamer (based on nucleic acid, protein, or peptide), a spiegelmer, RNAi, shRNA, microRNA (miRNA), a chromophor, a marker, preferably a fluorescent marker like FITC, biotin, a hormone, a signal peptide, a lipid, a fatty acid, a sugar, an amino acid, a receptor, a part of a receptor, or any ligand of a receptor or binding molecule, or glutathion.

In an alternative embodiment, the oligonucleotide modified at the 5'- or 3'-end via native ligation is temporarily or permanently connected to a solid support via the free 3'- or 5'-end of the oligonucleotide, or the native ligation site, preferably the cysteine residue of the native ligation site for example to thiol-sepharose. This embodiment allows further modification of the oligonucleotide at the 5'- and/or 3'-end, and/or the native ligation site, and/or at any site, which is not connected to the support. Alternatively, the connection of the modified oligonucleotide to a solid support forms the basis for a test system such as a kit, and/or allows purification of the modified oligonucleotide. An example of a solid support is a magnetic bead, which allows for example an easy isolation of the native ligation product via magnetism.

The polymers and compounds, respectively, bound to the oligonucleotide are either identical or differ for example in chemical structure, molecular weight (size), and reactivity. Hence, the method of the present invention results in a high variety of different oligonucleotide conjugates having a broad range of different characteristics allowing adapting the oligonucleotide specifically to any requirement. Hence, the present invention represents a platform technology for the modification of oligonucleotides, in particular antisense oligonucleotides.

FIGURES

FIG. 1-1 through FIG. 1-5 present examples of oligonucleotide sequences of exemplaric genes TGF-beta1, TGF-beta2, TGF-beta3, PGE-rec., VEGF, IL-10, c-erbb2 (Her-2), c-jun, c-fos, and MIA.

FIG. 2 shows a general reaction scheme of native ligation, wherein X is a polymer and/or compound, and Y is a modified oligonucleotide comprising a linker. RS⁻ is the leaving group.

FIG. 3 presents the 5'Cys-Oligo-synthesis. Step 1: synthesis of an oligonucleotide having an amino linker at the 3'-end and a cysteine modifier (OMR) at the 5'-end of the oligonucleotide; step 2: cleaving off of the Fmoc protection group from the cysteine modifier via piperidin, preferably 20%, in DMF; step 3: removing the oligonucleotide from the support and cleaving off of the permanent protection group via ammonia.

FIG. 4 shows the thioester modification of a polymer and/or compound, which will be coupled to an oligonucleotide via native ligation.

FIG. 5 presents the conjugation of the 5'-end of cysteine-modified oligonucleotide via native ligation.

FIG. 6 shows the protection and activation, respectively of the thiol-function of the cysteine residue (Native Ligation Site) for example via dipyridyldisulfide wherein R is a polymer and/or compound.

FIG. 7 demonstrates the conjugation of the 3'-end of a 5'-end conjugated oligonucleotide for example via NHS(N-hydroxysuccimid) linker, wherein R' and R" is a polymer and/or a compound.

FIG. 8 presents an example of 3'-cysteine oligonucleotide synthesis using for example a cysteine modified solid support.

FIG. 9 demonstrates increasing stability of a modified oligonucleotide against S1 endonuclease in comparison to an unmodified oligonucleotide, wherein FIG. 9a refers to the unmodified oligonucleotide, FIG. 9b to the mPEG400-Oligo-mPEG1000 (mPEG400 at the 5'-end of the oligonucleotide and mPEG1000 at the 3'-end of the oligonucleotide), and FIG. 9c to the mPEG1000-Oligo-mPEG400 (mPEG1000 at the 5'-end of the oligonucleotide and mPEG400 at the 3'-end of the oligonucleotide). Samples were taken at 0 h, 1 h, 24 h, 48 h, 72 h, and 144 h of incubation with S1 endonuclease.

FIG. 10 presents the increased stability of a modified oligonucleotide against 5'-exonuclease in comparison to an unmodified oligonucleotide, wherein FIG. 10a refers to the unmodified oligonucleotide, FIG. 10b to the mPEG400-Oligo-mPEG1000 (mPEG400 at the 5'-end of the oligonucleotide and mPEG1000 at the 3'-end of the oligonucleotide), and FIG. 10c to the mPEG1000-Oligo-mPEG400 (mPEG1000 at the 5'-end of the oligonucleotide and mPEG400 at the 3'-end of the oligonucleotide). Samples were taken at 0 h, 1 h, 24 h, 48 h, 72 h, and 144 h of incubation with 5'-exonuclease.

FIG. 11 shows the increased stability of a modified oligonucleotide against 3'-exonuclease in comparison to an unmodified oligonucleotide, wherein FIG. 11a refers to the unmodified oligonucleotide, FIG. 11b to the mPEG400-Oligo-mPEG1000 (mPEG400 at the 5'-end of the oligonucleotide and mPEG1000 at the 3'-end of the oligonucleotide), and FIG. 11c to the mPEG1000-Oligo-mPEG400 (mPEG1000 at the 5'-end of the oligonucleotide and mPEG400 at the 3'-end of the oligonucleotide). Samples were taken at 0 h, 1 h, 24 h, 48 h, 72 h, and 144 h of incubation with 3'-exonuclease.

FIG. 12 presents the schematic coupling of a 5'-/3'-end PEG modified oligonucleotide, which was modified at the 5'-end via native ligation according to the present invention, and a peptide at the oligonucleotide's native ligation site. The activated thiol residue of the oligonucleotide reacts with the free thiol residue at the C-terminus of the peptide by forming a disulfide bond and elimination of a pyridinthion.

FIG. 13 shows the results of the reaction of the 3'-end PEG modified oligonucleotide of SEQ ID No. 2461 and penetratin based on the principle presented in FIG. 12 (see Example 14). In FIG. 13A samples of the products were loaded on a 19% PAGE gel, which is silver stained: M is a marker comprising the antisense oligonucleotide (ASO)-2 nucleotides, ASO-1 nucleotide, i.e., the antisense oligonucleotide minus 1 or 2 nucleic acids, ASO, mPEG400-ASO-mPEG400, mPEG1000-ASO-mPEG1000, lane 1 shows the 3'-end PEG modified oligonucleotide without penetratin, lane 2 shows the 3'-end PEG modified oligonucleotide with 0.5× excess of penetratin, lane 3 shows the 3'-end PEG modified oligonucleotide with 1× excess of penetratin, lane 4 shows the 3'-end PEG modified oligonucleotide with 2× excess of penetratin, lane 5 shows the 3'-end PEG modified oligonucleotide with 4× excess of penetratin, lane 6 shows the 3'-end PEG modified oligonucleotide with 8× excess of penetratin, and lane 7 shows the 3'-end PEG modified oligonucleotide with 16× excess of penetratin; depending on the excess of penetratin the amount of PEG-modified oligonucleotide connected to penetratin increases. FIG. 13B shows a chromatogram of the 3'-end PEG modified oligonucleotide without penetratin (A) according to lane 1), and with 2× (B) according to lane 4) and 8× (C) according to lane 6) excess of penetratin, which is connected to the native ligation site, according to FIG. 13A.

FIG. 13C shows the curves of the chromatogram in more detail, wherein line A presents the 3'-end PEG modified oligonucleotide, line B presents the 3'-end PEG modified oligonucleotide, wherein penetratin is connected to the modified oligonucleotide when a 2× excess of penetratin was added to the modified oligonucleotide, and line C presents the 3'-end PEG modified oligonucleotide, wherein penetratin is connected to the modified oligonucleotide when an 8× excess of penetratin was added to the modified oligonucleotide.

FIG. 14 shows the results of the reaction of the 5'-/3'-end PEG modified oligonucleotide of SEQ ID No. 2030 and penetratin based on the principle presented in FIG. 12 (see Example 14). In FIG. 14A samples of the products were loaded on a 19% PAGE gel, which is silver stained: M is a marker comprising the antisense oligonucleotide (ASO)-2 nucleotides, ASO-1 nucleotide, ASO, mPEG400-ASO-mPEG400, mPEG1000-ASO-mPEG1000, lane 1 shows the 5'-/3'-end PEG modified oligonucleotide without penetratin, lane 2 shows the 5'-/3'-end PEG modified oligonucleotide with 0.5× excess of penetratin, lane 3 shows the 5'-/3'-end PEG modified oligonucleotide with 1× excess of penetratin, lane 4 shows the 5'-/3'-end PEG modified oligonucleotide with 2× excess of penetratin, lane 5 shows the 5'-/3'-end PEG modified oligonucleotide with 4× excess of penetratin, and lane 6 shows the 5'-/3'-end PEG modified oligonucleotide with 8× excess of penetratin; depending on the excess of penetratin the amount of PEG-modified oligonucleotide connected to penetratin increases. FIG. 14B shows a chromatogram of the 5'-/3'-end PEG modified oligonucleotide without penetratin (A) according to lane 1), and with 0.5× (B) according to lane 2), 2× (C) according to lane 4), and 8× (D) according to lane 6) excess of penetratin, which is connected to the native ligation site, according to FIG. 14A. FIG. 14C shows the curves of the chromatogram in more detail, wherein line A presents the 5'-/3'-end PEG modified oligonucleotide, line B presents the 5'-/3'-end PEG modified oligonucleotide, wherein penetratin is connected to the modified oligonucleotide when a 0.5× excess of penetratin was added to the modified oligonucleotide, line C presents the 5'-/3'-end PEG modified oligonucleotide, wherein penetratin is connected to the modified oligonucleotide when an 2× excess of penetratin was added to the modified oligonucleotide, and line D presents the 5'-/3'-end PEG modified oligonucleotide, wherein penetratin is connected to the modified oligonucleotide when an 8× excess of penetratin was added to the modified oligonucleotide.

FIG. 15 presents the results of experiments, where 5'-/3'-end PEG modified oligonucleotide of SEQ ID No. 2030 without an accessible native ligation site. Thus, even if penetratin is added to the oligonucleotide, no connection is detectable based on the principle presented in FIG. 12 (see Example 14), where the native ligation site is blocked. The samples of the products were loaded on a 19% PAGE gel, which is silver stained: M is a marker comprising the antisense oligonucleotide (ASO)-2 nucleotides, ASO-1 nucleotide, ASO mPEG400-ASO-mPEG400, mPEG1000-ASO-mPEG100, lane 1 shows the 5'-/3'-end PEG modified oligonucleotide without penetratin, lane 2 shows the 5'-/3'-end PEG modified oligonucleotide with 0.5× excess of penetratin, lane 3 shows the 5'-/3'-end PEG modified oligonucleotide with 1× excess of penetratin, lane 4 shows the 5'-/3'-end PEG modified oligonucleotide with 2× excess of penetratin, and lane 5 shows the 5'-/3'-end PEG modified oligonucleotide with 4× excess of penetratin. When the native ligation site is blocked no connection with penetratin is observable independent of the penetratin excess.

FIG. 16 presents the results of the reaction of the 5'-/3'-end PEG modified oligonucleotide and the RGDC peptide based on the principle presented in FIG. 12 (see Example 15). In FIG. 16A samples of the products were loaded on a 19% PAGE gel, which is silver stained: M is a marker comprising the antisense oligonucleotide (ASO)-2 nucleotides, ASO-1 nucleotide, ASO, mPEG400-ASO-mPEG400, mPEG1000-ASO-mPEG100, lane 1 shows the 5'-/3'-end PEG modified oligonucleotide, lane 2 shows the reaction product of RGDC peptide in a 0.5× excess connected to the native ligation site of the 5'-/3'-end PEG modified oligonucleotide, lane 3 shows the reaction product of RGDC peptide in a 2× excess connected to the native ligation site of the 5'-/3'-end PEG modified oligonucleotide, lane 4 in a 8× excess and lane 5 in a 16× excess. FIG. 16B shows a chromatogram of the 5'-/3'-end PEG modified oligonucleotide without RGDC (A) according to lane 1) and with 2× (B) according to lane 3) and 8× (C) according to lane 4) excess of RGDC which is connected to the native ligation site according to FIG. 16A. FIG. 16C shows the curves of the chromatogram in more detail, wherein line A presents the 5'-/3'-end PEG modified oligonucleotide, line B presents the 5'-/3'-end PEG modified oligonucleotide, wherein RGDC is connected to the modified oligonucleotide when a 2× excess of RGDC was added to the modified oligonucleotide, and line C presents the 5'-/3'-end PEG modified oligonucleotide, wherein RGDC is connected to the modified oligonucleotide when an 8× excess of RGDC was added to the modified oligonucleotide.

FIG. 17 presents the effect of 5'-/3'-end PEG-modified AP12009 on glioma cells (see Example 16), wherein AP12009 is modified via native ligation at the 5'-end end (derivative #26) in comparison to the effect of 5'-/3'-end PEG- and RGDC-modified AP12009, wherein AP12009 is modified via native ligation at the 5'-end end and RGDC is connected to the native ligation site (derivative #28) according to FIG. 14. FIG. 17A shows the effect on the proliferation of glioma cells and FIG. 17B on the expression of TGF-132, i.e., the inhibitory effect of AP12009 and its via native ligation modified forms. Black columns indicate AP12009, light grey columns indicate mPEG400-AP12009-mPEG1000 (derivative #26) and dark grey columns indicate 5'-/3'-end PEG modified AP 12009 connected to RGDC at the native ligation site, i.e., mPEG400-(RGDC-S)-Cys-AP12009-mPEG1000 (derivative #28). Derivative #28 is the most efficient form in suppressing TGF-beta2 expression in glioma cells compared to unmodified AP12009 and derivative #26. The concentrations of AP12009, derivative #26, and #28 used in this experiment were 0 µM, 0.25 µM, 0.5 µM, 1 µM, 2.5 µM, 5 µM, or 10 µM.

FIG. 18 shows the results of the reaction of the cystein comprising 5'-/3'-end PEG modified oligonucleotide and Iodoacetamide-Fluorescin as an example for an irreversible binding. In FIG. 15 the educt and the product were loaded on a 19% PAGE gel, which is silver stained: M is a marker comprising the antisense oligonucleotide (ASO)-2 nucleotides, ASO-1 nucleotide, ASO, mPEG400-ASO-mPEG400, mPEG1000-ASO-mPEG100, lane 1 shows the 5'-/3'-end PEG modified oligonucleotide without Fluorescein (educt), and lane 2 shows the 5'-/3'-end PEG modified oligonucleotide with Fluorescin connected to the native ligation site of the modified oligonucleotide.

DETAILED DESCRIPTION

The present invention is directed to a method providing a platform for a broad range of oligonucleotide conjugates based on highly specific modifications of the 5'-end of the oligonucleotide via native ligation. Preferably the 5'-end of the oligonucleotide is modified by binding of a polymer and/or a compound via native ligation, wherein the thiol function of the cysteine residue is called native ligation site. The cysteine residue remaining after native ligation is optionally modified by binding of a polymer and/or a compound. The 3'-end of the oligonucleotide is likewise optionally modified by binding of a polymer and/or a compound, wherein the 3'-end of the oligonucleotide is modified in a first step, in a second step after modification of the 5'-end of the oligonucleotide, or in a third step after modification of the 5'-end and the native ligation site of the oligonucleotide and conjugate, respectively. The native ligation site, which is preferably a cysteine residue of the polymer- and/or compound-oligonucleotide conjugate, is modified by binding of a further polymer and/or compound before or after modification of the 3'-end of the oligonucleotide.

Alternatively, the 3'-end of the oligonucleotide is modified with a polymer and/or compound via native ligation, and optionally, in addition, the 5'-end of the oligonucleotide, and/or the cysteine residue of the native ligation site is modified by binding to a polymer and/or a compound.

In some embodiments, the order of modifying the different positions of the oligonucleotide does not influence the characteristics of the oligonucleotide conjugate. In other embodiments, the order of the steps for modifying the oligonucleotide is essential to reach a specific oligonucleotide conjugate. Preferably, the 5'- or 3'-end of the oligonucleotide is modified via native ligation in a first step before modification of the free 3'- or 5'-end, or before modification of the native ligation site.

In another embodiment, both ends, i.e., the 5'- and the 3'-end of the oligonucleotide are modified via native ligation either one end after the other end, or both ends in parallel. If one end of the oligonucleotide is modified after the other via native ligation, the second end has to be protected when the first end is modified via native ligation. Preferred protecting groups are orthogonal protection groups.

In a further embodiment, the 5'-end and/or the 3'-end of the oligonucleotide and/or the native ligation site, in particular the cysteine residue, or any other residue of the oligonucleotide is modified by binding of a linker before binding of a polymer and/or a compound. The linker provides a high variety of different chemical bindings and allows reversible or irreversible binding of the polymer and/or the compound at each position of the oligonucleotide, preferably at the 5'-, 3'-end and/or native ligation site of the oligonucleotide.

Alternatively, a solid support is bound to the modified oligonucleotide, preferably at the 5'-end, the 3'-end and/or the native ligation site of the oligonucleotide. The binding of a solid support and the modified oligonucleotide forms for example the basis for a kit or purification system resulting for example in a highly purified modified oligonucleotide, which is not achievable with any other method.

A solid support is an insoluble, inert, functionalized, preferably polymeric material to which an oligonucleotide or a oligonucleotide conjugate is attached, optionally via a linker, for example allowing the oligonucleotide or the oligonucleotide conjugate to be readily separated (by filtration, centrifugation, etc.) from excess reagents, soluble reaction byproducts, or solvents. An example of a solid support is a magnetic bead, or a support used for oligonucleotide synthesis such as controlled pore glass, or thiol-activated sepharose for isolating and separating, respectively, of thiol containing conjugates (e.g. thiol-activated sepharose).

The present method allows the construction of an unlimited number of modifications for example all these different modifications explicitly disclosed in the specification, and thus, provides an advantageous platform for tailoring an oligonucleotide for specific requirements such as the combination of drug targeting, e.g., via an antibody, and the increase of the halflife of the oligonucleotide for example via a polymer such as a polyalkylene oxide, optionally in high purity. The method leads to the production of highly specifically modified oligonucleotides, preferably without the use of protection groups, tailored for any desired application and function, respectively.

The method of the present invention is advantageously not limited by the type or size and molecular weight, respectively, of the polymer and/or compound described.

The at least one polymer, for example starch, is either linear or branched, wherein the polymer comprises one or more, e.g., 2, 3, 4, 5, 6, 7, 8, 9, or 10 branching points. The term "branched" further comprises polymers such polyalkylene oxide, in particular PEG, which are combined via a linker, e.g., a Lys core to form a "pseudo-branched" polymer. In this case the polymer represents a monomer of a multi-polymer complex.

A polymer according to the present invention is any class of natural and/or synthetic substances composed of monomers and/or macromolecules that are multiples of monomers wherein the polymer optionally comprises natural and/or synthetic monomers. The monomers need not all be the same or have the same structure forming a homo- or copolymer. Polymers consist of long chains of unbranched or branched monomers, and/or are cross-linked networks of monomers in two or three dimensions. Their backbones are flexible or rigid. Many important natural materials are for example organic polymers, including polysaccharides, polypeptides, proteins, lignin, rubber, or nucleic acid. Polymers preferably increase the size and molecular weight of the oligonucleotide in the present invention and/or guide the oligonucleotide to the target. Polymers in the context of this application comprise biocompatible materials, such as polyalkylen oxides, more preferred polyethyleneglycol, for example alpha-, omega-dihydroxylpolyethyleneglycol, biodegradable lactone-based polymers, e.g. polyacrylic acid, polylactide acid (PLA), poly (glycolic acid) (PGA), polypropylene, polystyrene, polyolefin, polyamide, polycyanoacrylate, polyimide, polyethylenterephthalat (PET, PETG), polyethylene terephthalate (PETE), polytetramethylene glycol (PTG), or polyurethane as well as mixtures thereof. Mixture refers to the use of different polymers within the same compound as well as it refers to block copolymers. Block copolymers are polymers wherein at least one section of a polymer is build up from monomers of another polymer. Preferred polymers of the present invention are polyalkylene oxides such as PEG as well as polyethylene imide (PEI), or hydroxy ethyl starch (HES), wherein HES is preferably bound to the cysteine residue of the native ligation site via the thiol function. Selection of such materials depends on a number of factors including the stability and toxicity of the polymer.

A compound of the present invention is any substance having functional characteristics such as a small molecule, an antibody for example MUJ591, an antibody binding to glycoprotein IIb/IIIa, to CD52, to CD25, to VEGF, to the epidermal growth factor, to CD33, to CD20, or to carbonic anhydrase, an antigen for example an external domain of prostate-specific membrane antigen (PSMA), an enzyme, a part of an antibody, or an enzyme, any peptide, e.g., an internalizing peptide, a cell penetrating peptide such as penetratin (see Example 14), TAT (transactivator or transcription), Transportan (e.g., TP10), R9 peptide, MPG peptide, KALA peptide, a pH (low) insertion peptide, hormonal peptides such as LHRH, bombesin, somatostatin, or a targeting peptide such as RGD (Arg-Gly-Asp), in particular linear or cyclic RGD (see Example 15), an aptamer (based on nucleic acid, protein, or peptide), a spiegelmer, siRNA, e.g., cholesterol-modified siRNA, RNAi, shRNA, microRNA (miRNA), a human serum albumin carrier, a tumor vaccine such as a tumor antigen e.g., PSA, PAP, HIFalpha or an immune stimulatory agent, a cytotoxine such as TMZ, BCNU, DTIC, 5-Fluorouracil (FU), gemcitabine, taxol (pacitaxel), irinoteca, oxaliplatin doxorubicin, cyclophosphamid, folinsaure, a chromophor, a marker for example a fluorescent marker such as FITC, fluorescin (see Example 17), rhodamine, phycoerytherin, phycocynin, allophycocyanin, o-phthaldehyde or fluorescamine, biotin, a contrast agent, a chemiluminescent agent such as luminol, isoluminol, aromatic acridinium ester, imidazole, acridinium salt, or oxalate ester, a bioluminscent agent such as luciferin, luciferase or aequorin, a hormone, a signal peptide, a lipid, a fatty acid, e.g., conjugated linoleic acid, a sugar, an amino acid, a receptor, a part of a receptor, or any ligand of a receptor for example an antagonist of the CXCR4 chemokine receptor or binding molecule, or glutathione which enhances the delivery of the conjugate via the glutathione transferes for example across the blood-brain-barrier.

An RGD (Arg-Gly-Asp) peptide for example is linear or cyclic and consists of RGD or comprises RGD for example Arg-Gly-Asp-D-Phe-Cys, Arg-Gly-Asp-D-Phe-Glu, Arg-Gly-Asp-D-Phe-Lys, H-Gly-Arg-Gly-Asp-Asn-Pro-OH, or H-Gly-Gly-Gly-Gly-Arg-Gly-Asp-Ser-Pro-OH.

A compound of the present invention is preferably directed to the targeting and/or detecting of the oligonucleotide. Advantageously, the compounds, in particular markers and chromophors, are solidly bound to the oligonucleotide, preferably via native ligation or to the native ligation site, which reduces amongst others the risk of false positive results due to unbound markers, chromophors etc.

In a preferred embodiment, a polymer and/or compound, which is connected to the oligonucleotide via the native ligation site comprises an additional sterically available cysteine residue for example at the end or within the polymer and/or compound like the N-terminus, the C-terminus or within the polymer or compound such as a peptide, preferably for potential further bindings of polymers and/or compounds.

A conjugate of the present invention is an oligonucleotide, preferably an antisense oligonucleotide comprising a polymer and/or a compound at the 5'-end and/or the 3'-end of the oligonucleotide and/or at the native ligation site(s), wherein the 5'-end (FIG. 5) or the 3'-end (FIG. 8) of the oligonucleotide is or both ends are modified via native ligation.

Modification of an oligonucleotide means the binding of a polymer and/or a compound to the oligonucleotide, preferably to the 5'-end and/or the 3'-end of the oligonucleotide and/or the native ligation site, wherein the polymer and/or compound is bound to the 5'- and/or 3'-end of the oligonucleotide via native ligation or to one of the 5'- or 3'-ends with or without a linker.

The free end of an oligonucleotide or of an oligonucleotide conjugate is the 5'-end and 3'-end, respectively, of the oligonucleotide, which is optionally bound to a linker, and is free of a polymer and/or a compound. The free end of the oligonucleotide or the oligonucleotide conjugate is suitable to be bound to a polymer and/or a compound with or without a linker.

The direct binding of at least one polymer and/or at least one compound to an oligonucleotide results in a conjugate, i.e., a polymer-oligonucleotide, a compound-oligonucleotide, or a mixed compound-polymer-oligonucleotide conjugate. Further polymers and/or compounds are optionally bound to the oligonucleotide and conjugate, respectively, either directly at any position of the oligonucleotide for example at a phosphate group, a sugar moiety, and/or a base of the oligonucleotide, preferably at the 5'-, 3'-end and/or native ligation site of the oligonucleotide, or indirectly via a polymer or compound already bound to the oligonucleotide and conjugate, respectively. If only the 5'-end of the oligonucleotide is modified with a polymer or a compound via native ligation, the polymer or the compound is preferably not a peptide or a protein.

In a further embodiment one or more polymers and/or compounds are bound to the oligonucleotide and/or to a polymer and/or compound already bound to the oligonucleotide with or without a linker. The term "linker" comprises any type of linker, preferably cross-linker, which refer to any chemical substance able to bind at least two molecules such as an oligonucleotide and at least one polymer and/or compound. Linkers include zero length linkers, homobifunctional crosslinkers, heterobifunctional cross linkers and the like. Different linkers are usable and combinable, respectively, in a conjugate of the invention. In addition, a linker connects two or more oligonucleotides, which are modified or will be modified. Depending on the linker, the binding of the polymer and/or compound to the oligonucleotide is reversible for example via disulfide binding, or irreversible for example via thioether binding.

An example for a linker, which connects a polymer and/or a compound, preferably a peptide, to a native ligation site is a Peptide Modifying Reagent (PMR) such as pentafluorophenyl S-benzyl-thiosuccinate (e.g., OPeC® Conjugation Reagents of link technologies).

Further linkers of the invention are for example homobifunctional linkers such as Lomant's reagent dithiobis (succinimidylpropionate) DSP, 3'3'-dithiobis(sulfosuccinimidyl proprionate (DTSSP), disuccinimidyl suberate (DSS), bis (sulfosuccinimidyl)suberate (BS), disuccinimidyl tartrate (DST), disulfosuccinimidyl tartrate (sulfo DST), ethylene glycobis(succinimidylsuccinate) (EGS), disuccinimidyl glutarate (DSG), N,N'-disuccinimidyl carbonate (DSC), dimethyl adipimidate (DMA), dimethyl pimelimidate (DMP), dimethyl suberimidate (DMS), dimethyl-3,3'-dithiobispropionimidate (DTBP), 1,4-di-3'-(2'-pyridyldithio)propionamido)butane (DPDPB), bismaleimidohexane (BMH), aryl halide-containing compound (DFDNB), such as e.g. 1,5-difluoro-2,4-dinitrobenzene or 1,3-difluoro-4,6-dinitrobenzene, 4,4'-difluoro-3,3'-dinitrophenylsulfone (DFDNPS), bis-[β-(4-azidosalicylamido)ethyl]disulfide (BASED), formaldehyde, glutaraldehyde, 1,4-butanediol diglycidyl ether, adipic acid dihydrazide, carbohydrazide, o-toluidine, 3,3'-dimethylbenzidine, benzidine, α,α'-p-diaminodiphenyl, diiodo-p-xylene sulfonic acid, N,N'-ethylene-bis(iodoacetamide), N,N'-hexamethylene-bis(iodoacetamide).

The linkage with heterobifunctional linkers is preferred, which increases specificity of the reaction. Examples for heterobifunctional linkers are amine-reactive and sulfhydryl cross-linkers such as N-succinimidyl 3-(2-pyridyldithio)propionate (sPDP), long-chain N-succinimidyl 3-(2-pyridyldithio)propionate (LC-sPDP), water-soluble-long-chain N-succinimidyl 3-(2-pyridyldithio) propionate (sulfo-LC-sPDP), succinimidyloxycarbonyl-α-methyl-α-(2-pyridyldithio)toluene (sMPT), sulfosuccinimidyl-6-[α-methyl-α-(2-pyridyldithio)toluamido]hexanoate (sulfo-LC-sMPT), succinimidyl-4-(N-maleimidomethyl)cyclohexane-1-carboxylate (sMCC), sulfosuccinimidyl-4-(N-maleimidomethyl)cyclohexane-1-carboxylate (sulfo-sMCC), m-maleimidobenzoyl-N-hydroxysuccinimide ester (MBs), m-maleimidobenzoyl-N-hydroxysulfosuccinimide ester (sulfo-MBs), N-succinimidyl(4-iodoacetyl)aminobenzoate (sIAB), sulfosuccinimidyl(4-iodoacteyl)aminobenzoate (sulfo-sIAB), succinimidyl-4-(p-maleimidophenyl)butyrate (sMPB), sulfosuccinimidyl-4-(p-maleimidophenyl)butyrate (sulfo-sMPB), N-(γ-maleimidobutyryloxy)succinimide ester (GMBs), N-(γ-maleimidobutyryloxy)sulfosuccinimide ester (sulfo-GMBs), succinimidyl 6-(((iodoacetyl)amino)hexanoate (sIAX), succinimidyl 6-[6-(((iodoacetyl)amino)hexanoyl)amino]hexanoate (sIAXX), succinimidyl 4-(((iodoacetyl)amino)methyl)cyclohexane-1-carboxylate (sIAC), succinimidyl 6-((((4-iodoacetyl)amino)methyl)cyclohexane-1-carbonyl)amino) hexanoate (sIACX), p-nitrophenyl iodoacetate (NPIA), carbonyl-reactive and sulfhydryl-reactive cross-linkers such as 4-(4-N-maleimidophenyl)butyric acid hydrazide (MPBH), 4-(N-maleimidomethyl)cyclohexane-1-carboxyl-hydrazide-8 ($M_2C_2H$), 3-(2-pyridyldithio) propionyl hydrazide (PDPH), amine-reactive and photoreactive cross-linkers such as N-hydroxysuccinimidyl-4-azidosalicylic acid (NHs-AsA), N-hydroxysulfosuccinimidyl-4-azidosalicylic acid (sulfo-NHs-AsA), sulfosuccinimidyl-(4-azidosalicylamido)hexanoate (sulfo-NHs-LC-AsA), sulfosuccinimidyl-2-(p-azidosalicylamido)ethyl-1,3'-dithiopropionate (sAsD), N-hydroxysuccinimidyl-4-azidobenzoate (HsAB), N-hydroxysulfosuccinimidyl-4-azidobenzoate (sulfo-HsAB), N-succinimidyl-6-(4'-azido-2'-nitrophenylamino)hexanoate (sANPAH), sulfosuccinimidyl-6-(4'-azido-2'-nitrophenylamino)hexanoate (sulfo-sANPAH), N-5-azido-2-nitrobenzoyloxysuccinimide (ANB-NOs), sulfosuccinimidyl-2-(m-azido-o-nitrobenzamido)-ethyl-1,3'-dithiopropionate (sAND), N-succinimidyl-4(4-azidophenyl)1,3'-dithiopropionate (sADP), N-sulfosuccinimidyl(4-azidophenyl)-1,3'-dithiopropionate (sulfo-sADP), sulfosuccinimidyl 4-(p-azidophenyl)butyrate (sulfo-sAPB), sulfosuccinimidyl 2-(7-azido-4-methylcoumarin-3-acetamide)ethyl-1,3'-dithiopropionate (sAED), sulfosuccinimidyl 7-azido-4-methylcoumain-3-acetate (sulfo-sAMCA), ρ-nitrophenyl diazopyruvate (ρNPDP), ρ-nitrophenyl-2-diazo-3,3,3-trifluoropropionate (PNP-DTP), sulfhydryl-reactive and photoreactive cross-linkers such as 1-(ρ-Azidosalicylamido)-4-(iodoacetamido)butane (AsIB), N-[4-(ρ-azidosalicylamido)butyl]-3'-(2'-pyridyldithio)propionamide (APDP), benzophenone-4-iodoacetamide, benzophenone-4-maleimide carbonyl-reactive and photoreactive cross-linkers such as p-azidobenzoyl hydrazide (ABH), carboxylate-reactive and photoreactive cross-linkers such as 4-(ρ-azidosalicylamido) butylamine (AsBA), and arginine-reactive and photoreactive cross-linkers such as ρ-azidophenyl glyoxal (APG). For more details see Hermanson (1996).

The oligonucleotide, a polymer and/or a compound, optionally including a linker, are covalently bound to each other, wherein the polymer and/or the compound is preferably bound to the 5'-end and/or 3'-end of the oligonucleotide and/or to the native ligation site. Optionally, the oligonucleotide, the polymer and/or the compound form non-covalent bindings such as intermolecular forces, ionic interactions, e.g., Watson-Crick base pairing, wherein the polymer and/or the compound is likewise preferably bound to the 5'-end and/or 3'-end of the oligonucleotide and/or to the native ligation site.

The size of an oligonucleotide, which is modified according to the present invention, comprises or consists of at least 5 nucleotides, preferably of between 5 and 70 nucleotides, more preferably of between 10 and 60 nucleotides, even more preferably of between 10 and 40 nucleotides, with higher preference of between 12 and 25 nucleotides, and most preferred of between 12 and 20 nucleotides. In particular the oligonucleotide comprises or consists of 10, 11, 12, 13, 14, 15, 16, 17, 18, 19, 20, 21, 22, 23, 24, or 25 nucleotides. The oligonucleotide is generated in any manner, preferably by chemical synthesis, DNA replication, reverse transcription, or a combination thereof, or isolated from a natural source.

Preferably, the oligonucleotide in the context of the invention comprises any type of oligonucleotide including an oligonucleotide derivative having e.g., an additional functional group for example an amino group for example at one or both ends of the oligonucleotide. These groups form the basis for example for the reaction with a polymer and/or compound leading to a conjugate such as a PEGylated oligonucleotide.

Further, oligonucleotides comprise nucleotide building blocks composed of base, sugar, and phosphate moiety. Oligonucleotides include oligonucleotides having non-naturally occurring oligonucleotide building blocks with similar function. Naturally occurring nucleotides as well as non-naturally occurring nucleotides, modifications of these nucleotides at the base, the sugar or the backbone as well as spacers instead of a at least one nucleotide are also referred to as nucleotide building block. Modifications of an oligonucleotide are for example phosphorothioate, methylphosphonate, phosphoramidate, or 2'-modifications of the sugar (e.g., 2'-O-methyl oligonucleotide, 2'-O-methoxy-ethyl oligonucleotide, or 2'-deoxy-2'-fluoro oligonucleotide).

The oligonucleotide preferably comprises at least 5 nucleotide building blocks, preferably 5 to 120 nucleotide building blocks, more preferably 8 to 30 nucleotide building blocks, even more preferably 10 to 28 nucleotide building blocks, even more preferred 12 to 26 nucleotide building blocks, most preferred 10, 11, 12, 13, 14, 15, 16, 17, 18, 19, 20, 21, 22, 23, 24, 25, or 26 nucleotide building blocks.

The term nucleotide building block comprises nucleotides composed of naturally-occurring nucleobases, sugars and covalent internucleoside (backbone) linkages, each of these also referred to as portions, as well as oligonucleotides having non-naturally-occurring portions which function similarly, e.g. hybridizing with the same mRNA of a selected target. In one embodiment the base is modified or substituted by a similar molecule. Similar bases are those molecules that are also able to support the hybridization to the mRNA or at least do not affect the hybridization in a negative way. In some embodiments at least one base portion is substituted with a spacer.

In other embodiments the sugar moiety of the nucleotide building block is modified or substituted by another group, structure, or moiety. Examples for sugars are arabinose, xylose, lyxose, allose, altrose, glucose, mannose, gulose, idose, galactose, talose or stabilized modifications of those sugars. In some embodiments a spacer substitutes the sugar.

In other embodiments the internucleoside linkage, also referred to a linkage between two nucleotide building blocks, is not a phosphorodiester but another group, structure, or moiety. Such oligonucleotides with at least one modified nucleotide building block are often preferred over native forms because of desirable properties such as enhanced cellular uptake, enhanced affinity for nucleic acid target, increased stability in the presence of nucleases and/or enhanced therapeutic effectiveness.

Oligonucleotides, having a modified nucleotide building block, further comprise for example peptide nucleic acid (PNA), locked nucleic acid (LNA), and morpholinos as shown in the following:

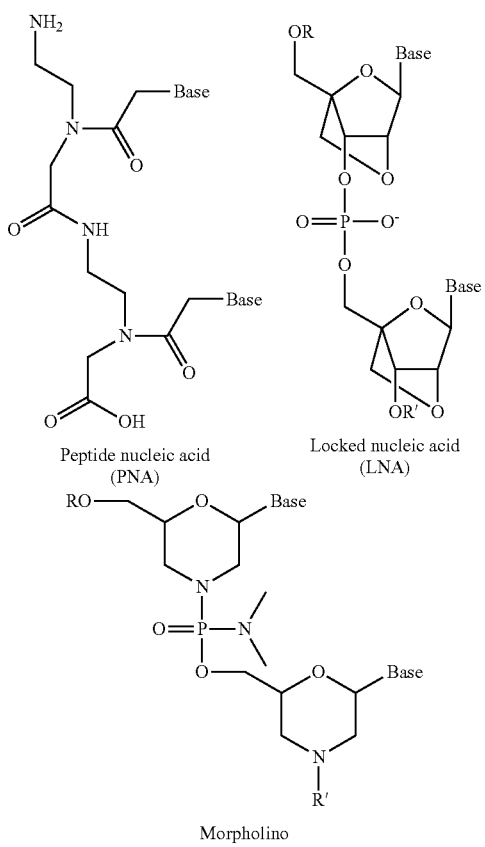

Peptide nucleic acid (PNA)

Locked nucleic acid (LNA)

Morpholino

PNA is chemically similar to DNA and RNA, and is generally artificially synthesized. The PNA's backbone is composed for example of repeating N-(2-aminoethyl)-glycine units linked by peptide bonds. The various purine and pyrimidine bases are preferably linked to the backbone by methylene carbonyl bonds.

LNA is modified RNA, wherein the ribose moiety of an LNA nucleotide is modified with an extra bridge connecting the 2' and 4' carbons. The bridge "locks" the ribose in the 3'-endo structural conformations, which is often found in the A-form of DNA or RNA. LNA is combinable with DNA or RNA bases in an oligonucleotide.

Morpholino oligonucleotides are an antisense technology used to block access of other molecules to specific sequences with nucleic acid. Morpholinos block small (about 25 base) regions of the base-pairing surface of RNA or DNA.

In the context of this invention, the term oligonucleotide refers to an oligomer of ribonucleic acid (RNA) or deoxyribonucleic acid (DNA) or mimetics thereof also referred to as nucleotide building block-polymers. The term oligonucleotide comprises single and double stranded RNA or DNA. In case of double stranded RNA or DNA the strands are blunt end or with overhanging ends, wherein one strand has an overhang on one end of the other strand or on both ends of the other strand, or one strand has an overhang on one side and the other strand has an overhang on the opposite side.

The term oligonucleotide further comprises aptamers and/or spiegelmers. Aptamers are nucleic acid molecules, comprising at least 5 or 8 nucleotides, preferably 10 to 100 nucleotides, more preferably 25 to 75 nucleotides, even more preferably 30 to 70 nucleotides, most preferred between 40 to 60 nucleotides, having specific binding affinity to molecules through interactions other than classic Watson-Crick base pairing. Aptamers are engineered through repeated rounds of in vitro selection or equivalently, SELEX (systemic evolution of ligands by exponential enrichment) to bind to various molecular targets such as small molecules, proteins, nucleic acids, even cells, tissues and organisms, preferably with affinities in the nanomolar to the picomolar range. Aptamers are for example engineered completely in a test tube, are readily produced by chemical synthesis, possess desirable storage properties, and elicit little or no immunogenicity in therapeutic applications. Moreover, aptamers are combinable with ribozymes to self-cleave in the presence of their target molecule.

Spiegelmers are developed on basis of aptamers. They consist of nucleotides having the L-form leading to a high resistance against nucleases. Hence, spiegelmers have all the diversity characteristics of aptamers as well as their binding characteristics, preferably in the low nanomolar to picomolar range, but possess a structure that prevents enzymatic degradation. Aptamers and spiegelmers bind both to extracellular and intracellular molecules such as a receptor or its ligand, to a transcription factor, or a lipid-containing molecule.

Furthermore, the term oligonucleotide comprises siRNA, RNAi, shRNA, and microRNA (miRNA). RNAi is a mechanism for RNA-guided regulation of gene expression in which double-stranded ribonucleic acid inhibits preferably the expression of genes with complementary nucleotide sequences. The RNAi pathway is initiated by the enzyme dicer, which cleaves double-stranded RNA to short double-stranded fragments preferably of 15 to 35 base pairs, more preferably of 20 to 30 base pairs, and most preferably 20 to 25 base pairs. One of the two strands of each fragment, which is the "guide strand", is incorporated into the RNA-induced silencing complex (RISC) and base-pairs with a complementary sequence. The most-well studied effect of RNAi is post-transcriptional gene silencing, which occurs when the guide strand base pairs with a mRNA and induces degradation of the mRNA for example by argonaute, a catalytic component of the RISC complex. The short fragments are known as small interfering or silencing RNA (siRNA), which are preferably perfectly complementary to the gene, which is to be suppressed. In addition to their role in RNAi pathway, siRNA also act in RNAi-related pathways, e.g., as an antiviral mechanism or in shaping the chromatin structure of a genome. Similar to siRNA, microRNA (miRNA), which are single-stranded RNA molecules of 15 to 30 nucleotides, preferably 20 to 30 nucleotides, and most preferably 21 to 23 nucleotides, regulate preferably gene expression. miRNA is encoded by genes that are transcribed from DNA, but not translated into protein (non-coding RNA). Instead the miRNA is processed from primary transcripts known as pre-miRNA preferably to short stem-loop structures such as pre-miRNA and finally to functional miRNA. A further type of RNA preferably involved in gene silencing is short hairpin RNA (shRNA). shRNA is RNA which makes a tight hairpin turn that is preferably suitable to silence gene expression via RNAi. shRNA uses a vector introduced into cells and utilizes a promoter, preferably the U6 promoter, to ensure that the shRNA is expressed. The vector is preferably passed on to daughter cells, allowing the gene silencing to be inherited. The cellular machinery preferably cleaves the shRNA hairpin structure, preferably into siRNA, which is then binding to RISC and starts the mechanism as described above.

Additionally, the term oligonucleotide comprises CpG oligonucleotides. CpG motifs induce preferably Toll-like receptor mediated immune response by simulating bacterial DNA. The CpG oligonucleotide preferably activates immune cells such as dendritic cells and B-lymphocytes, and stimulates NF-κB. CpG oligonucleotides are in general not a target sequence specific approach.

Moreover, the term oligonucleotide comprises a decoy oligonucleotide, also known as "decoy", which is preferably a double-strand oligonucleotide bearing a consensus binding sequence for example of a specific transcription factor for manipulating gene expression.

The oligonucleotide of the present invention preferably hybridizes with mRNA of a molecule negatively influencing a physiological and/or biochemical effect in a cell or hybridizes with mRNA of the receptor of the molecule. In a preferred embodiment, the modified oligonucleotide of the present invention hybridizes with mRNA of TGF-beta1, TGF-beta2, TGF-beta3, VEGF, IL-10, c-jun, c-fos, Her-2, MIA, receptors thereof, and/or prostaglandin E2 receptor, or binds to and interacts with, respectively, a target in form of an aptamer or a spiegelmer. Further preferred embodiments of oligonucleotides are given in the sequence listing, or are oligonucleotides published in WO 94/25588, WO 95/17507, WO 95/02051, WO 98/33904, WO 99/63975, WO 01/68146, WO 01/68122, WO 03/06445, WO 2005/014812, WO 2005/059133, WO 2005/084712 herein incorporated by reference.

Preferred oligonucleotides that are linked with at least one polymer and/or at least one compound according to the present invention comprise or consist of at least one of SEQ ID NO 1 to 435 (cf. FIG. 1), or of example 10.

Especially preferred oligonucleotides consist of or comprise SEQ ID NO. 2030, 2031, 2032, 2057 and/or 2066. Mostly preferred are the oligonucleotides comprising or consisting of SEQ ID No.: 2030 (CGGCATGTCTATTTTGTA) and/or SEQ ID No.: 2057 (CTGATGTGTTGAAGAACA).

In a preferred embodiment, the modified oligonucleotide of the present invention is a novel, improved therapeutic agent for controlling, treating and/or preventing one or more of cellular proliferative and/or differentiating diseases or disorders, diseases or disorders associated with bone metabolism, immune, hematopoietic, cardiovascular, liver, kidney, muscular, hematological, viral, pain, neurological and/or metabolic diseases or disorders, in particular disorders or diseases associated with undesired TGF-beta signaling. The term cancer, carcinoma, or neoplasm includes malignancies of the various organ systems for example such affecting brain, eye, lung, breast, thyroid, lymphoid, gastrointestinal, and genitourinary tract.

The diseases or disorders, in particular maligne or benign tumors or metastases and their formation, which are controllable, preventable and/or treatable with a modified oligonucleotide of the present invention, or a pharmaceutical composition comprising or consisting of such modified oligonucleotide include, but are not limited to solid tumors, blood born tumors such as leukemias, acute or chronic myelotic or lymphoblastic leukemia, tumor metastasis, benign tumors, for example hemangiomas, acoustic neuromas, neurofibromas, trachomas, pyogenic granulomas, premalignant tumors, rheumatoid arthritis, psoriasis, astrocytoma, acoustic neuroma, blastoma, craniopharyngloma, ependymoma, Ewing's tumor, medulloblastoma, glioma, hemanglioblastoma, Hodgkins-lymphoma, medullablastoma, leukaemia, mesothelioma, neuroblastoma, neurofibroma, non-Hodgkins lymphoma, pinealoma, retinoblastoma, sarcoma (including angiosarcoma, chondrosarcoma, endothelialsarcoma, fibrosarcoma, leiomyosarcoma, liposarcoma, lymphangioandotheliosarcoma, lyphangiosarcoma, melanoma, meningioma, myosarcoma, oligodendroglioma, osteogenic sarcoma, osteosarcoma), seminoma, trachomas, Wilm's tumor, or is selected from the group of bile duct carcinoma, bladder carcinoma, brain tumor, breast cancer, bronchogenic carcinoma, carcinoma of the kidney, cervical cancer, choriocarcinoma, cystadenocarcinome, embryonal carcinoma, epithelial carcinoma, esophageal cancer, cervical carcinoma, colon carcinoma, colorectal carcinoma, endometrial cancer, gallbladder cancer, gastric cancer, head cancer, liver carcinoma, lung carcinoma, medullary carcinoma, neck cancer, non-small-cell bronchogenic/lung carcinoma, ovarian cancer, pancreas carcinoma, papillary carcinoma, papillary adenocarcinoma, prostate cancer, small intestine carcinoma, prostate carcinoma, rectal cancer, renal cell carcinoma, skin cancer, small-cell bronchogenic/lung carcinoma, squamous cell carcinoma, sebaceous gland carcinoma, testicular carcinoma, uterine cancer, liver metastasis, lung metastasis, brain metastasis, metastasis of lymphoma.

The modified oligonucleotides of the invention as well as the pharmaceutical compositions comprising or consisting of one or more such modified oligonucleotides are also suitable to control, prevent and/or treat a variety of immune disorders such as autoimmune diseases or disorders, e.g., diabetes mellitus, arthritis, including rheumatoid arthritis, juvenile rheumatoid arthritis, osteoarthritis, psoriacathritis; multiple sclerosis, encephalomyelitis, myasthenia gravis, systemic lupus erythrematosis, autoimmunethyroiditis, dermatitis, including atopis dermatitis, eczematous dermatitis; psoriasis, Sjogren's Syndrome, Crohn's disease, aphthous ulcer, irits, conjunctivitis, keratoconjunctivitis, ulcerative colitis, asthma, allergic asthma, cutaneous lupus erythematosus, scleroderma, vaginitis, proctitis, drug eruptions, leprosy reversal reactions, erythema nodosum leprosum, autoimmune uveitis, allergic encephalomyelitis, acute necrotizing hemorrhagic encephalopathy, idiopathic bilateral progressive sensorineural hearing loss, aplastic anemia, pure red cell anemia, idiopathic thrombocytopenia, polychondritis, Wegener's granulomatosis, chronic active hepatitis, Stevens-Johnson syndrome, idiopathic sprue, lichen planus, Graves' disease, sarcoidosis, primary billiary cirrhosis, uveitis posterior, and interstitial lung fibrosis, graft-versus-host disease, cases of transplantation, and allergy such as an atopic allergy. Moreover, the modified oligonucleotide or the pharmaceutical composition is suitable to control, prevent and/or treat cardiovascular diseases or disorders such as hypertension, atherosclerosis, coronary artery spasm, congestive heart failure, coronary artery disease, valvular disease, arrhythmias, and cardiomyopathies; or viral diseases or disorders for example hepatitis A (HVA), hepatitis B (HVB), hepatitis C (HVC), or caused by herpes simplex virus (HSV), HIV, FIV, poliovirus, influenza virus, adenoviruses, papillomaviruses, Epstein-Barr-viruses and small pox virus, or virus-associated cancer such as hepatocellular cancer.

The modified oligonucleotides of the invention as well as the pharmaceutical compositions comprising or consisting of one or more such oligonucleotides are further suitable to control, prevent and/or treat fibrotic diseases or disorders which are for example associated with undesired TGF-beta signaling, which include, without limitation, kidney disorders and (excessive) fibrosis and/or sclerosis, such as glomerulonephritis (GN) of all etiologies, e.g., mesangial proliferative GN, immune GN, crescentic GN; diabetic nephropathy, renal interstitial fibrosis and all causes of renal interstitial fibrosis including hypertension, renal fibrosis resulting from complications of drug exposure, including cyclosporin treatment of transplant recipients, HIV-associated nephropathy, or transplant nephropathy; hepatic diseases associated with (excessive) scarring and (progressive) sclerosis for example cirrhosis due to all etiologies, disorders of the biliary tree, and hepatic dysfunction; pulmonary fibrosis with consequential loss of gas exchange or ability to efficiently move air into and out of the lungs such as adult respiratory distress syndrome (ARDS), chronic obstructive pulmonary disease (COPD), idiopathic pulmonary fibrosis (IPF), acute lung injury (ALI) or pulmonary fibrosis due to infectious or toxic agents such as smoke, chemicals, allergens, or autoimmune diseases; eye diseases or disorders associated with fibroproliferative states such as fibroproliferative vitreoretinopathy of any etiology or fibrosis associated with ocular surgery, e.g., treatment of glaucoma, retinal reattachment, cataract extraction, or drainage procedures of any kind; excessive or hypertrophic scar formation in the dermis occurring for example during wound healing resulting from trauma or surgical wounds. The modified oligonucleotides, and compositions of the invention, respectively, are particularly designed to target genes associated with particular diseases or disorders, preferably TGF-β such as TGF-β1, -β2, or -β3.

The oligonucleotide conjugate of this invention is administrable by different routes, which include, but are not limited to electroporation, epidermal, impression into skin, intra-arterial, intra-articular, intra-cranial, intra-thecal, intra-cerebral, intra-dermal, intra-lesional, intra-muscular, intra-nasal, intra-ocular, intra-peritoneal, intra-prostatic, intra-pulmonary, intra-spinal, intra-tracheal, intra-tumoral, intra-venous, intra-vesical placement within cavities of the body, nasal inhalation, oral, pulmonary inhalation (e.g., by inhalation or insufflation of powders or aerosols, including by nebulizer), subcutaneous, subdermal, transdermal, or topical (including ophthalmic and to mucous membranes including vaginal and rectal delivery). Topical administration further comprises administration of the skin, the eyes and the ears.

In one embodiment, a cytokine and/or a chemotherapeutic is co-administered with one or more oligonucleotide conjugates of the invention. The cytokine and/or the chemotherapeutic increases the effect of the oligonucleotide and/or of one or more compounds bound to the oligonucleotide for example a small molecule, an antibody for example MUJ591, an antibody binding to glycoprotein IIb/IIIa, to CD52, to CD25, to VEGF, to the epidermal growth factor, to CD33, to CD20, or to carbonic anhydrase, an antigen for example an external domain of prostate-specific membrane antigen (PSMA), an enzyme, a part of an antibody, or an enzyme, any peptide, e.g., an internalizing peptide, a cell penetrating peptide such as penetratin, TAT (transactivator or transcription), Transportan (e.g., TP10), R9 peptide, MPG peptide, KALA peptide, a pH (low) insertion peptide, hormonal peptides such as LHRH, bombesin, somatostatin, or a targeting peptide such as RGD (Arg-Gly-Asp), an aptamer (based on nucleic acid, protein, or peptide), a spiegelmer, siRNA, e.g., cholesterol-modified siRNA, RNAi, shRNA, microRNA (miRNA), a human serum albumin carrier, a tumor vaccine such as a tumor antigen e.g., PSA, PAP, HIFalpha or an immune stimulatory agent, a cytotoxine such as TMZ, BCNU, DTIC, 5-Fluorouracil (FU), gemcitabine, taxol (pacitaxel), irinoteca, oxaliplatin doxorubicin, cyclophosphamid., folinsaure, a chromophor, a marker for example a fluorescent marker such as FITC, rhodamine, phycoerytherin, phycocynin, allophycocyanin, o-phthaldehyde or fluorescamine, biotin, a contrast agent, a chemiluminescent agent such as luminol, isoluminol, aromatic acridinium ester, imidazole, acridinium salt, or oxalate ester, a bioluminscent agent such as luciferin, luciferase or aequorin, a hormone, a signal peptide, a lipid, a fatty acid, e.g., conjugated linoleic acid, a sugar, an amino acid, a receptor, a part of a receptor, or any ligand of a receptor for example an antagonist of the CXCR4 chemokine receptor or binding molecule, or glutathione which enhances the delivery of the conjugate via the glutathione transferase for example across the blood-brain-barrier. A compound of the present invention is preferably directed to the targeting and/or detecting of the oligonucleotide. Preferred cytokines are for example interferones such as α-, β- or γ-interferone (IFN), interleukins (IL) such as IL-1α, -1β, -2, -3 -4, -5, -6, -7, -8, -9, -10, -11, -12, -13, -16, -17, -18, -22, -23, or 31, or colony stimulating factors (CSF) such as CSF1, -2 (GM-CSF or sargramostin), or -3 (G-CSF or filgrastim), or a combination thereof. Preferred chemotherapeutics are for example alkylating agents, antimetabolites, anthracyclines, alkaloids, topoisomerase inhibitors, and antitumor agents, in particular temozolomide, gemcitabine, avastin, or a combination thereof.

In a preferred embodiment, a polymer such as polylakylene oxide, e.g., PEG is bound to the 5'-end and/or 3'-end of an oligonucleotide via native ligation resulting in a native ligation site, preferably comprising a cysteine residue, which is either protected to avoid interaction of a further polymer and/or compound with the native ligation site, or is bound to a polymer such as PEG, or a compound such as a small molecule, an antibody, an antigen, an enzyme, a part of an antibody, or an enzyme, any peptide, e.g., an internalizing peptide, an aptamer (based on nucleic acid, protein, or peptide), a spiegelmer, RNAi, shRNA, microRNA (miRNA) a chromophor, biotin, a hormone, a signal peptide, a lipid, a fatty acid, a sugar, an amino acid, a receptor, a part of a receptor, or any ligand of a receptor or binding molecule, optionally via a reversible or irreversible linker.

Preferably, hydroxy protecting groups are for example t-butyl, t-butoxymethyl, methoxymethyl, tetrahydropyranyl, 1-ethoxyethyl, 1-(2-chloroethoxy)ethyl, 2-trimethylsilyl ethyl, p-chlorophenyl, 2,4-dinitrophenyl, benzyl, 2,6-dichlorobenzyl, diphenylmethyl, p, dinitrobenzylhydryl, triphenylmethyl, trimethylsilyl, triethylsilyl, t-butyldimethylsilyl, t-butyldiphenylsilyl, triphenylsilyl, benzoylformate, acetate, chloroacetate, trichloroacetate, trifluoroacetate, pivaloate, benzoate, p-phenylbenzoate, 9-fluorenylmethyl carbonate, mesylate and tosylate.

Amino protecting groups are for example dimethoxytrityl (DMT), monomethoxyethyl (MMT), 2-trimethylsilylethoxycarbonyl (Teoc), 1-methyl-1-(4-biphenylyl)ethoxycarbonyl (Bpoc), t-butoxycarbonyl (BOC), allyloxycarbonyl (Alloc), 9-fluorenylmethyloxycarbonyl (Fmoc), benzyloxycarbonyl (Cbz); amide protecting groups such as formyl, acetyl, trihaloacetyl, benzoyl, and nitrophenylacetyl; sulfonamide protecting groups such as 2-nitrobenzenesulfonyl, or imine and cyclic imide protecting groups such as phthalimido and dithiasuccinoyl.

Carbonyl protecting groups are for example acetals, ketals, acylals, or dithianes. Carboxylic acid protecting groups are for example methyl esters, benzyl esters, tert-butyl esters, or silyl esters.

Thiol protecting reagents are for example ethyliodoacetate, an irreversible capping reagent, resulting in thioether, or dipyridyldisulfide, a reversible protection group, resulting in disulfide, Benzyl-S or tert. Butyl-S etc.

Equivalents of the protecting groups such as hydroxy protecting groups, carbonyl protecting groups, carboxylic acid protecting groups, thiol protecting groups or amino protecting groups are also encompassed by the conjugates or compounds and the methods of their production.

In a further preferred embodiment, the oligonucleotide conjugate of the present invention based on native ligation comprises a polyalkylene oxide, e.g., PEG at the 5'- and/or 3'-end, and optionally a polymer such as PEG and/or a compound like penetratin and/or an RGD peptide at the native ligation site, wherein the polyalkylene oxide such as PEG at both ends is identical in size or differs in size.

Polymers for example polyalkylene oxide, in particular PEG is available as polydispers or monodispers material. The polydispers material comprises dispers distribution of different molecular weight of the material, characterized by mean weight (weight average) size and dispersity. The monodispers PEG comprises one size of molecules. Polyalkylene oxide, preferably PEG, of the present invention is poly- or monodispers and the indicated molecular weight represents an average of the molecular weight of the polyalkylene oxide, e.g., PEG, molecules. Molecular weights indicated for polymers, in particular PEGs are often rounded; alternatively, polymers, in particular PEGs are indicated according to the number of monomers the polymer comprises, for example PEG4 comprises 4 monomers and has a molecular weight of 200.

For example the molecular weight of a polymer for example polyalkylene oxide such as PEG, which is linked to the 5'-end of the oligonucleotide is 200 (e.g., PEG 4), 300, 400 (e.g., PEG 8), 500, 600, 700, 800, 900, 1000 (e.g. PEG 24), 1250, 1500, 1750, 2000, 2250, 2500, 2750, 3000, 3250, 3500, 3750, 4000, 4250, 4500 or 4750, 5000, 10000, 20000, 50000 or 100000 Da and the molecular weight of the polyalkylene oxide linked to the 3'-end of the oligonucleotide is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da, or the molecular weight of the polymer for example polyalkylene oxide such as PEG linked to the 3'-end of the oligonucleotide is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da and the molecular weight of the polymer for example polyalkylene oxide such as PEG linked to the 5'-end of the oligonucleotide is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da, or the molecular weight of the polymer for example polyalkylene oxide such as PEG linked to the 5'-end and/or the 3'-end of the oligonucleotide is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da and the molecular weight of the polymer for example polyalkylene oxide such as PEG linked to the native ligation site is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da, or the molecular weight of the polymer for example polyalkylene oxide such as PEG linked to the native ligation site is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da and the molecular weight of the polymer for example polyalkylene oxide such as PEG linked to the 5'-end and/or the 3'-end of the oligonucleotide is 200, 300, 400, 500, 600, 700, 800, 900, 1000, 1250, 1500, 1750, 2000, 2250, 2500, 2750, 3000, 3250, 3500, 3750, 4000, 4250, 4500 or 4750, 5000, 10000, 20000, 50000 or 100000 Da. Polymers, in particular PEGs of the present invention are preferably monodispers polymers and PEGs, respectively.

In a further preferred embodiment, the modified oligonucleotide comprises a polymer for example polyalkylene oxide such as PEG, and a compound for example an antibody and an internalizing peptide such as penetratin or an RGD peptide. The antibody guides the modified oligonucleotide to the target, and the PEG avoids amongst others and reduces, respectively, degradation of the modified oligonucleotide for example via 5'- and/or 3'-exonuclease, and/or endonuclease. Once the target is reached, the antibody and/or the PEG is/are separated from the modified oligonucleotide, preferably via a reversible linker such as a disulfide binding, and the internalizing peptide promotes entrance of the oligonucleotide into the target cell. Alternatively, the modified oligonucleotide comprises a polymer such as PEG at the 5'-end or at the 5'- and 3'-end of the oligonucleotide, and a compound such as an antibody at the 3'-end or at the native ligation site of the oligonucleotide for example. Once the target is reached, the modified oligonucleotide interacts with the surface of the target cell.

In a further alternative, an oligonucleotide comprises a polymer for example PEG at its 5'- and 3'-end, which are connected to the oligonucleotide via native ligation, resulting in two native ligation sites at the 5'- and the 3-end of the oligonucleotide. A compound like an antibody, e.g., for targeting, and an internalizing peptide such as penetratin are connected independently to one of the native ligation sites. Once the target is reached, the antibody is removed from the oligonucleotide and/or the compounds, e.g., the PEGs are removed and the penetratin improves the incorporation of the oligonucleotide into the cell.

In another embodiment, a solid phase is connected to the 3'-end and/or the native ligation site of the modified oligonucleotide comprising a polymer and/or a compound at the 5'-end. Such combination forms for example the basis for a test kit using the modified oligonucleotide for the detection of a cell or cell factor.

The following examples will further illustrate the present invention without limiting the subject matter of the present invention to these examples.

EXAMPLES

The present invention is further described with references to the following examples, wherein the invention is not limited to the examples. The oligonucleotides used in the following examples were preferably SEQ ID No. 2030, 2031, 2032, 2057, 2066, and 2461, in particular SEQ ID No. 2030.

Example 1

Synthesis of a 5'-Cysteine-Modified Oligonucleotide-Thiophosphate (FIG. 3)

Synthesis of an oligonucleotide having a phosphorothioate backbone on a DNA/RNA synthesizer according to a modified synthesis protocol comprising double coupling cycles on an amino-on-support in a 2 µmol scale (2 µmol net weight of functional groups of the support per cartridge). In the last step comprising a single coupling step, a cysteine modifier such as OMR (oligonucleotide-modifying reagents for example Link-technologies Ltd., Lanarkshire, Scotland) dissolved in 0.1 M acetonitril was connected to the 5'-end of the oligonucleotide, wherein the OMR is protected with a Fmoc and a tertiary Butyl-S-(tBu-S) protecting group. Once, the synthesis of the oligonucleotide is finished, the Fmoc protecting group is removed from the OMR using 20% piperidine in dimethyl formamide (DMF). Piperidine is then removed by washing the oligonucleotide in pure DMF, which is finally removed by acetonitril. The support is removed from the cartridge, dried at 37° C. then the oligonucleotide is cleaved from the solid support by ammonia overnight, preferably by concentrated ammonia at 55° C.

The final product is purified via HPLC, wherein the eluate is collected and the volume of the eluate is reduced via ultracentrifugation or ultrafiltration, quantified, dried preferably in a speedvac and stored at −20° C. The identity of the product is controlled via MALDI-TOF-MS.

Example 2

Production of a PMR-Modified PEG Component (FIG. 4)

Starting material for the PEG modified with a thioester is for example common amino functionalized PEG and PMR (peptide-modifying reagents (pentafluorophenyl-5-benzyl-thiosuccinat) for example Link-technologies Ltd., Lanarkshire, Scotland). 100 μmol methoxy-PEG-NH2 of MW 400 (mPEG400-NH2), i.e., 400 μl of a 250 mM solution in DMF, is mixed with a 1.5× excess of PMR, i.e., 150 μmol (58 mg) in 100 μl DMF, and added to 5000 solution of 30 μmol (4.6 mg) HOBt (N-hydroxybenzotriazole). The composition is incubated for 30 min. at 37° C. The reaction is controlled using an analytic RP-HPLC, wherein the mPEG400-PMR forms a sharp peak, and the isolation of mPEG400-PMR was likewise performed on RP-HPLC. The isolated PEG400-PMR is dried, ultrafiltrated, and/or ultracentrifuged and stored at −20° C.

Example 3

Modification of the 5'-End of a 5'-OMR-Modified Oligonucleotide Via Native Ligation (FIG. 5)

The modification of the 5'-end of the oligonucleotide is based on the reaction of the thioester of the PEG-PMR component, for example the mPEG400-PMR component (see example 2), with the cysteine residue of the OMR-modified oligonucleotide (see example 1). In a first step an intermediate thioester bond is formed followed by an intramolecular acyl rearrangement resulting in an amide bond, i.e., native ligation.

The reaction buffer for the native ligation comprises 100 mM Tris(carboxyethyl)phosphine (TCEP), 50 mM Triethylammonium acetate (TEAA) pH7.5, and 25 mM Mercaptophenyl acetic acid (MPAA) for an oligonucleotide concentration of 1 nmol/μl and an mPEG400-PMR concentration of 10 nmol/μl.

In a first step the 5'-OMR-modified oligonucleotide comprising cysteine is chemically reduced via TCEP to remove the tertiary Butyl-S (tBu-S) protecting group from the cysteine residue of the 5'-OMR-modified oligonucleotide. The mixture is incubated for 1 h at 37° C., and the reaction is controlled using RP-HPLC.

Parallel, in a second independent step, the PEG-PMR-compound/-polymer such as the mPEG400-PMR is activated via MPAA by interacting with the mPEG-PMR and exchanging the Benzyl-S (Bn-S) group of the thioester; this mixture is likewise incubated for 1 h at 37° C., and the reaction is controlled using RP-HPLC.

The combination of the reduced oligonucleotide of step one and the activated PEG-PMR-compound/-polymer of step two, and the incubation at 37° C. leads to native ligation resulting in the final product of the reaction comprising an amide bond. Reaction time is between 24 and 200 h.

Example 4

Protection of the Thiol Residue Via Dipyridyldisulfide (FIG. 6)

The thiol function of the cysteine-residue of the PEG-PMR-oligonucleotide intermediate product, which is the direct product of native ligation (see example 3), is protected by adding an 1000× molar excess of dipyridyldisulfide (1M Dithiopyridin, Py2S2 dissolved in methanol) to the reaction buffer of example 3; the mixture is incubated at 37° C. for about 20 h; alternatively DTNB or Ellman's reagents were used. The resulting product, which is for example a mPEG400-PMR, 5'-end PEG modified oligonucleotide comprising cysteine having a protecting group at the cysteine residue, is isolated via ultrafiltration and RP-HPLC; the final product is dried and stored at −20° C.

Example 5

Modification of the 3'-End of a Native Ligation Modified Oligonucleotide (FIG. 7)

The modification of the 3'-end of the 5'-end native ligation modified oligonucleotide comprising a pyridyl-disulfide protected cysteine (see example 4) is based on the reaction of the 3'-terminal amino function with for example PEG-NHS such as mPEG2000-NHS. Reaction buffer is 0.3M $NaHCO_3$ pH 8.5 for an oligonucleotide concentration of 1 mM. About 10 times 3× excess of mPEG-NHS is added to the 5'-end PEG modified oligonucleotide, and is incubated at 37° C. for 10 min. The reaction is controlled via RP-HPLC, and the final product is isolated via RP-HPLC, IE-FPLC, or ultrafiltration which is subsequently dried for example in a speedvac, and stored at −20° C.

Example 6

Stability of an Unmodified Oligonucleotide Against Endonuclease, 5'-Exonuclease, and 3'-Endonuclease, Respectively An unmodified oligonucleotide comprising 18 nucleotides and a phosphate or a thiophosphate backbone was incubated with S1 endonuclease (0.005 U/μl, i.e., 0.05 Upper nmol oligonucleotide) in 70 mM Tris-HCl, 50 mM NaCl, 20 mM $MgCl_2$, pH 7 at 37° C.

A second sample of the unmodified oligonucleotide was incubated with 5'-exonuclease (for example phosphodiesterase II (PDE II)) in 0.1 M TEAA buffer pH 6.5 (0.018 U/μl, i.e., 0.18 Upper nmol oligonucleotide), and a third group of the unmodified oligonucleotide was incubated with 3'-exonuclease (for example phosphodiesterase I (PDE I)) in 100 mM Tris-HCl, 100 mM NaCl, 14 mM $MgCl_2$, pH 8.8 (0.0001 U/μl, i.e., 0.001 Upper nmol oligonucleotide).

The results are presented in the following, wherein the amount of oligonucleotide at t=0 was set 100%. The degradation of the oligonucleotides of all three samples was tested by RP-HPLC directly at the start of the experiment (t=0), after 1 h, 24 h, 48 h, and 144 h. Table 1 shows the results of the endonuclease, table 2 of the 5'-exonuclease, and table 3 of the 3'-exonuclease.

TABLE 1

Effect of the endonuclease (S1)

| | Unmodified oligonucleotide comprising phosphate backbone | Unmodified oligonucleotide comprising thiophosphate backbone |
|---|---|---|
| 0 h | 100% | 100% |
| 1 h | 16% | 21% |
| 24 h | —* | 4% |
| 48 h | —* | —* |
| 144 h | —* | —* |

*No oligonucleotide detectable at 24 h, 48 h and 144 h

TABLE 2

Effect of the 5'-exonuclease (PDE II)

| | Unmodified oligonucleotide comprising phosphate backbone | Unmodified oligonucleotide comprising thiophosphate backbone |
|---|---|---|
| 0 h | 100% | 100% |
| 1 h | 24% | 100% |
| 24 h | 16% | 86% |
| 48 h | —* | 79% |
| 144 h | —* | 63% |

*No oligonucleotide detectable at 48 h and 144 h

TABLE 3

Effect of the 3'-exonuclease (PDE I)

| | Unmodified oligonucleotide comprising phosphate backbone | Unmodified oligonucleotide comprising thiophosphate backbone |
|---|---|---|
| 0 h | 100% | 100% |
| 1 h | 30% | 96% |
| 24 h | —* | 66% |
| 48 h | —* | 54% |
| 144 h | —* | 20% |

*No oligonucleotide detectable at 24 h, 48 h and 144 h

Example 7

Stability of the Modified Oligonucleotides Against Endonuclease

A modified oligonucleotide comprising a thiophosphate backbone was bound to mPEG400 at the 5'-end of the oligonucleotide via native ligation and to mPEG2000 (mPEG400-Oligo-mPEG2000) at the 3'-end via NHS ester coupled to the 3'-aminofunction of the oligonucleotide and incubated with S1 endonuclease (0.005 U/µl, i.e., 0.05 Upper nmol oligonucleotide) in 70 mM Tris-HCl, 50 mM NaCl, 20 mM $MgCl_2$, pH 7 at 37° C. The degradation of the oligonucleotide was tested by RP-HPLC directly at the start of the experiment (t=0), after 1 h, 24 h, 48 h, and 144 h. Table 4 shows the results of these experiments.

TABLE 4

Effect of the endonuclease (S1)

| | mPEG400-Oligo-mPEG2000 |
|---|---|
| 0 h | 100% |
| 1 h | 100% |
| 24 h | 90% |
| 48 h | 85% |
| 144 h | 66% |

The modified oligonucleotides show a higher stability than the unmodified oligonucleotides of table 1.

Example 8

Testing Stability of the Modified Oligonucleotides Against Endonuclease on PAGE (FIG. 9a-c)

An unmodified oligonucleotide and modified oligonucleotides comprising a thiophosphate backbone were incubated with S1 endonuclease (0.005 U/µl, i.e., 0.05 Upper nmol oligonucleotide) in 70 mM Tris-HCl, 50 mM NaCl, 20 mM $MgCl_2$, pH 7 at 37° C. The modified oligonucleotides were either bound to mPEG400 at the 5'-end of the oligonucleotide via native ligation and to mPEG1000 (mPEG400-Oligo-mPEG1000) at the 3'-end via NHS ester or to mPEG1000 at the 5'-end of the oligonucleotide via native ligation and to mPEG1000 (mPEG1000-Oligo-mPEG400) at the 3'-end via NHS ester. The degradation of the oligonucleotides was tested by PAGE directly at the start of the experiment (t=0), after 1 h, 24 h, 48 h, 72 h, and 144 h. 1 µl (0.01 nmol) of each sample was mixed with 5 µl formamide and the samples were separated on a polyacrylamid gel via polyacrylamid gel electrophoresis (PAGE) comprising 6.3 g urea, 7.5 ml acrylamid/bisacrylamid 19:1 (40%), 1.5. ml TBE buffer (10×), 1.5 ml water, 90 µl Amoniumpersulfat (APS) and 7 µl N,N,N',N'-Tetramethylenethylenediamine (TEMED). Current time of the gel was about 2.5 h at 5 mA. The weight marker on the gel comprises 0.01 nmol mPEG1000-Oligo-mPEG1000, mPEG400-Oligo-mPEG400, unmodified oligonucleotide, unmodified oligonucleotide (n–1), and unmodified oligonucleotide (n–2) (decreasing size).

FIG. 9a shows the results of the unmodified oligonucleotide, FIG. 9b of the mPEG400-Oligo-mPEG1000, and FIG. 9c of the mPEG1000-Oligo-mPEG400, which demonstrate an increased stability of mPEG400-Oligo-mPEG1000 and mPEG1000-Oligo-mPEG400 against S1 endonuclease incubation.

Example 9

Stability of the Modified Oligonucleotides Against 5'-Exonuclease (PDE II)

A modified oligonucleotide comprising a thiophosphate backbone was bound to mPEG400 at the 5'-end of the oligonucleotide via native ligation and to PEG1000 at the 3'-end of the oligonucleotide via reaction of an NHS ester with the 3'-aminofunction (mPEG400-Oligo-mPEG1000) and was incubated with 5'-exonuclease in 0.1 M TEAA buffer pH 6.5 (0.018 U/µl, i.e., 0.18 Upper nmol oligonucleotide), at 37° C. The degradation of the oligonucleotide was tested directly at the start of the experiment (t=0), after 1 h, 24 h, 48 h, and 144 h. Table 5 shows the results of these experiments.

TABLE 5

Effect of the 5'-exonuclease (PDE II)

| | mPEG400-Oligo-mPEG1000 |
|---|---|
| 0 h | 100% |
| 1 h | 97% |
| 24 h | 95% |
| 48 h | 92% |
| 144 h | 91% |

The modified oligonucleotides show a higher stability than the unmodified oligonucleotides of table 2.

Example 10

Testing Stability of the Modified Oligonucleotides Against 5'-Exonuclease (PDE II) on PAGE (FIG. 10a-c)

An unmodified oligonucleotide and modified oligonucleotides comprising a thiophosphate backbone were incubated with 5'-exonuclease (0.018 U/µl, i.e., 0.18 Upper nmol oligonucleotide) in 0.1M TEAA buffer pH 6.5 at 37° C. The modified oligonucleotides were either bound to mPEG400 at the 5'-end of the oligonucleotide via native ligation and to mPEG1000 (mPEG400-Oligo-mPEG1000) at the 3'-end via NHS ester or to mPEG1000 at the 5'-end of the oligonucleotide via native ligation and to mPEG1000 (mPEG1000-Oligo-mPEG400) at the 3'-end via NHS ester. The degradation of the oligonucleotides was tested by RP-HPLC directly at the start of the experiment (t=0), after 1 h, 24 h, 48 h, 72 h, and 144 h. The samples were tested on PAGE according to Example 8.

FIG. 10a shows the results of the unmodified oligonucleotide, FIG. 10b of the mPEG400-Oligo-mPEG1000, and FIG. 10c of the mPEG1000-Oligo-mPEG400, which demonstrate an increased stability of mPEG400-Oligo-mPEG1000 and mPEG1000-Oligo-mPEG400 against 5'-exonuclease incubation.

Example 11

Stability of the Modified Oligonucleotides Against 3'-Exonuclease (PDE I)

A modified oligonucleotide comprising a thiophosphate backbone was bound to mPEG400 at the 5'-end of the oligonucleotide via native ligation and to mPEG1000 at the 3'-end of the oligonucleotide via NHS ester (mPEG400-Oligo-mPEG1000) and was incubated with 3'-exonuclease in 100 mM Tris-HCl, 100 mM NaCl, 14 mM $MgCl_2$, pH 8.8 (0.0001 U/µl, i.e., 0.001 Upper nmol oligonucleotide) at 37° C. The degradation of the oligonucleotide was tested by RP-HPLC directly at the start of the experiment (t=0), after 1 h, 24 h, 48 h, and 144 h. Table 6 shows the results of these experiments.

TABLE 6

Effect of the 3'-exonuclease (PDE I)

| | PEG400-Oligo-PEG1000 |
|---|---|
| 0 h | 100% |
| 1 h | 98% |
| 24 h | 79% |
| 48 h | 62% |
| 144 h | 44% |

The modified oligonucleotides show a higher stability than the unmodified oligonucleotides of table 3.

Example 12

Testing Stability of the Modified Oligonucleotides Against 3'-Exonuclease (PDE I) on PAGE (FIG. 11a-c)

An unmodified oligonucleotide and modified oligonucleotides comprising a thiophosphate backbone were incubated with 3'-exonuclease (0.0001 U/µl, i.e., 0.001 Upper nmol oligonucleotide) in 100 mM Tris-HCl buffer 100 mM NaCl, 14 mM $MgCl_2$, pH 8.8 at 37° C. The modified oligonucleotides were either bound to mPEG400 at the 5'-end of the oligonucleotide via native ligation and to mPEG1000 (mPEG400-Oligo-mPEG1000) at the 3'-end via NHS ester or to mPEG1000 at the 5'-end of the oligonucleotide via native ligation and to mPEG1000 (mPEG1000-Oligo-mPEG400) at the 3'-end via NHS ester. The degradation of the oligonucleotides was tested by PAGE directly at the start of the experiment (t=0), after 1 h, 24 h, 48 h, 72 h, and 144 h. The samples were tested on PAGE according to Example 8. FIG. 11a shows the results of the unmodified oligonucleotide, FIG. 11b of the mPEG400-Oligo-mPEG1000, and FIG. 11c of the mPEG1000-Oligo-mPEG400, which demonstrate an increased stability of mPEG400-Oligo-mPEG1000 and mPEG1000-Oligo-mPEG400 against 3'-exonuclease incubation.

Example 13

Oligonucleotides

The TGF-beta1, TGF-beta2 and TGF-beta3 oligonucleotides, in particular antisense oligonucleotides, of this example are bound to a polymer and/or compound according to the method of the present invention, which are suitable for controlling, preventing, and/or treating of unwanted neoplasms, formation of metastases, fibrosis or viral diseases or disorders such as HIV as described in this invention.

TGF-Beta1, -2 and -3 Antisense Oligonucleotides:

```
gtgccatcaatacctgcaaa,        (SEQ ID No. 1)

catcagttacatcgaaggag,        (SEQ ID No. 2)

tcttgggacacgcagcaagg,        (SEQ ID No. 3)

gaaatcaatgtaaagtggac,        (SEQ ID No. 4)

catgaactggtccatatcga,        (SEQ ID No. 5)

gaggttctaaatcttgggac,        (SEQ ID No. 6)

gcactctggcttttgggttc,        (SEQ ID No. 7)

tagctcaatccgttgttcag,        (SEQ ID No. 8)

ccctagatccctcttgaaat,        (SEQ ID No. 9)
```

| | |
|---|---|
| accaaggctctcttatgttt, | (SEQ ID No. 10) |
| tcgagtgtgctgcaggtaga, | (SEQ ID No. 11) |
| tgaacagcatcagttacatc, | (SEQ ID No. 12) |
| gctgggttggagatgttaaa, | (SEQ ID No. 13) |
| agaggttctaaatcttggga, | (SEQ ID No. 14) |
| cgccggttggtctgttgtga, | (SEQ ID No. 15) |
| ctgctttcaccaaattggaa, | (SEQ ID No. 16) |
| aagtatagatcaaggagagt, | (SEQ ID No. 17) |
| tgctcaggatctgcccgcgg, | (SEQ ID No. 18) |
| gtgctgttgtagatggaaat, | (SEQ ID No. 19) |
| agggcggcatgtctattttg, | (SEQ ID No. 20) |
| taagcttatttaaatccca, | (SEQ ID No. 21) |
| tagctgcatttgcaagactt, | (SEQ ID No. 22) |
| tctgttgtgactcaagtctg, | (SEQ ID No. 23) |
| aagcaataggccgcatccaa, | (SEQ ID No. 24) |
| tcaatgtaaagtggacgtag, | (SEQ ID No. 25) |
| attttagctgcatttgcaag, | (SEQ ID No. 26) |
| tgtagatggaaatcacctcc, | (SEQ ID No. 27) |
| ttaacactgatgaaccaagg, | (SEQ ID No. 28) |
| attgtacccttttgggttcgt, | (SEQ ID No. 29) |
| agatccctcttgaaatcaat, | (SEQ ID No. 30) |
| tgtaaagtggacgtaggcag, | (SEQ ID No. 31) |
| ccattcgccttctgctcttg, | (SEQ ID No. 32) |
| tgttaaatctttggacttga, | (SEQ ID No. 33) |
| gaagggcggcatgtctattt, | (SEQ ID No. 34) |
| gaccctgctgtgctgagtgt, | (SEQ ID No. 35) |
| gaactagtaccgccttttca, | (SEQ ID No. 36) |
| cgatcctcttgcgcatgaac, | (SEQ ID No. 37) |
| ccggccaaaagggaagagat, | (SEQ ID No. 38) |
| aaagagacgagtggctatta, | (SEQ ID No. 39) |
| aagtggaaatattaatacgg, | (SEQ ID No. 40) |
| agatcaaggagagttgtttg, | (SEQ ID No. 41) |
| agttgttttaaaagtcaga, | (SEQ ID No. 42) |
| tgtaacaactgggcagacag, | (SEQ ID No. 43) |
| ggtgttgtaacaactgggca, | (SEQ ID No. 44) |
| tacccacagagcacctggga, | (SEQ ID No. 45) |
| gggatggcatcaaggtaccc, | (SEQ ID No. 46) |
| tcgtcatcatcattatcatc, | (SEQ ID No. 47) |
| aagggtgcctattgcatagc, | (SEQ ID No. 48) |
| ctcactgttaactctaagag, | (SEQ ID No. 49) |
| gcaaagtatttggtctccac, | (SEQ ID No. 50) |
| caagttccttaagccatcca, | (SEQ ID No. 51) |
| ttatcttaatgcagactttc, | (SEQ ID No. 52) |
| cttacaagaagcttccttag, | (SEQ ID No. 53) |
| actggtgagcttcagcttgc, | (SEQ ID No. 54) |
| acttgagaatctgatatagc, | (SEQ ID No. 55) |
| aggttcctgtctttatggtg, | (SEQ ID No. 56) |
| gtgtatccatttccaccta, | (SEQ ID No. 57) |
| cagcacagaagttggcattg, | (SEQ ID No. 58) |
| gcaaggagaagcagatgctt, | (SEQ ID No. 59) |
| agcaaggagaagcagatgct, | (SEQ ID No. 60) |
| ttttccaagaattttagctg, | (SEQ ID No. 61) |
| ttcttgttacaagcatcatc, | (SEQ ID No. 62) |
| ttaaagaaggagcggttcgg, | (SEQ ID No. 63) |
| ctgggctgaaatttatatat, | (SEQ ID No. 64) |
| gggcagacagctaggagttt, | (SEQ ID No. 65) |
| gtgtactcaccaaggtaccc, | (SEQ ID No. 66) |
| cccagcactttgggaggccg, | (SEQ ID No. 67) |
| ggctcacgcctgtaatccca, | (SEQ ID No. 68) |
| tgaccgtgaactcactattt, | (SEQ ID No. 69) |
| atagtggtgatggctataca, | (SEQ ID No. 70) |
| ttttggttacctgcaaatct, | (SEQ ID No. 71) |
| gaacactcaccctgctgtgc, | (SEQ ID No. 72) |
| gaatggctctttaaaccccta, | (SEQ ID No. 73) |
| gaagaaatggagttcagtgt, | (SEQ ID No. 74) |
| tttctcctggaagggagagg, | (SEQ ID No. 75) |
| aaatgcaacgcgttcccaac, | (SEQ ID No. 76) |
| aatacgaaacttttgcaaag, | (SEQ ID No. 77) |
| actagtaattctcagagcgg, | (SEQ ID No. 78) |
| aagaaactagtaattctcag, | (SEQ ID No. 79) |
| agtgcatgtttttaaaagga, | (SEQ ID No. 80) |
| cagtagtgcatgtttttaaa, | (SEQ ID No. 81) |
| ctcagcacacagtagtgcat, | (SEQ ID No. 82) |
| agatgcaggagcaaaaaggt, | (SEQ ID No. 83) |
| caggtagacagactgagcgc, | (SEQ ID No. 84) |
| gcctcgatcctcttgcgcat, | (SEQ ID No. 85) |
| gcggatggcctcgatcctct, | (SEQ ID No. 86) |
| ctcaggatctgcccgcggat, | (SEQ ID No. 87) |
| gctccggatagtcttccggg, | (SEQ ID No. 88) |
| agatggaaatcacctccggg, | (SEQ ID No. 89) |
| gttgtagatggaaatcacct, | (SEQ ID No. 90) |

| | |
|---|---|
| ctggtactgttgtagatgga, | (SEQ ID No. 91) |
| aggcggctgccctccggctt, | (SEQ ID No. 92) |
| aacctccttggcgtagtact, | (SEQ ID No. 93) |
| attttataaacctccttggc, | (SEQ ID No. 94) |
| cggcatgtcgattttataaa, | (SEQ ID No. 95) |
| cgggatggcattttcggagg, | (SEQ ID No. 96) |
| gtagggtctgtagaaagtgg, | (SEQ ID No. 97) |
| tgaagtagggtctgtagaaa, | (SEQ ID No. 98) |
| attctgaagtagggtctgta, | (SEQ ID No. 99) |
| aagcggacgattctgaagta, | (SEQ ID No. 100) |
| cccaggttcctgtctttgtg, | (SEQ ID No. 101) |
| ggcagtgtaaacttattttta, | (SEQ ID No. 102) |
| ccatcaatacctgcaaatct, | (SEQ ID No. 103) |
| aggtgccatcaatacctgca, | (SEQ ID No. 104) |
| agttttctgatcaccactgg, | (SEQ ID No. 105) |
| ttatagttttctgatcacca, | (SEQ ID No. 106) |
| cctagtggactttatagttt, | (SEQ ID No. 107) |
| acattagcaggagatgtggg, | (SEQ ID No. 108) |
| agggcaacaacattagcagg, | (SEQ ID No. 109) |
| actccagtctgtaggagggc, | (SEQ ID No. 110) |
| tcctgcacatttctaaagca, | (SEQ ID No. 111) |
| cagcaattatcctgcacatt, | (SEQ ID No. 112) |
| atgtaaagagggcgaaggca, | (SEQ ID No. 113) |
| ctcttaaaatcaatgtaaag, | (SEQ ID No. 114) |
| ccaagatccctcttaaaatc, | (SEQ ID No. 115) |
| cctttgggttcatggatcca, | (SEQ ID No. 116) |
| gcattgtaccctttgggttc, | (SEQ ID No. 117) |
| gcacagaagttagcattgta, | (SEQ ID No. 118) |
| ctgaggactttggtgtgttg, | (SEQ ID No. 119) |
| tcctgggacacacagcaagg, | (SEQ ID No. 120) |
| tttagctgcatttacaagac, | (SEQ ID No. 121) |
| caaggactttagctgcattt, | (SEQ ID No. 122) |
| gtcattgtaccgtgatttt, | (SEQ ID No. 123) |
| ccagttttaacaaacagaac, | (SEQ ID No. 124) |
| agatgccagttttaacaaac, | (SEQ ID No. 125) |
| gttcattatatagtaacaca, | (SEQ ID No. 126) |
| atgaaaggttcattatatag, | (SEQ ID No. 127) |
| ttccaagggtaatgaaaggt, | (SEQ ID No. 128) |
| cttaagccatccatgagttt, | (SEQ ID No. 129) |
| cctggcttatttgagttcaa, | (SEQ ID No. 130) |
| ttagtcctataacaactcac, | (SEQ ID No. 131) |
| gcaaagaaccatttacaatt, | (SEQ ID No. 132) |
| cttgcttaaactggcaaaga, | (SEQ ID No. 133) |
| acatgtaaagtagttactgt, | (SEQ ID No. 134) |
| acacattacatgtaaagtag, | (SEQ ID No. 135) |
| taagatctacacattacatg, | (SEQ ID No. 136) |
| attcaaaggtactggccagc, | (SEQ ID No. 137) |
| tttgtagtgcaagtcaaaat, | (SEQ ID No. 138) |
| catgtcattaaatggacaat, | (SEQ ID No. 139) |
| cctacatttgtgcgaacttc, | (SEQ ID No. 140) |
| ttcccccttgaaaaactca, | (SEQ ID No. 141) |
| tttttaatcagcctgcaaag, | (SEQ ID No. 142) |
| actgggcagacagtttcgga, | (SEQ ID No. 143) |
| taacaactgggcagacagtt, | (SEQ ID No. 144) |
| tgttgtaacaactgggcaga, | (SEQ ID No. 145) |
| cacagagcacctgggactgt, | (SEQ ID No. 146) |
| gtacccacagagcacctggg, | (SEQ ID No. 147) |
| tcaaggtacccacagagcac, | (SEQ ID No. 148) |
| tggcatcaaggtacccacag, | (SEQ ID No. 149) |
| ggcgggatggcatcaaggta, | (SEQ ID No. 150) |
| tttgcaggtattgatggcac, | (SEQ ID No. 151) |
| ctccttcgatgtaactgatg, | (SEQ ID No. 152) |
| ccttgctgcgtgtcccaaga, | (SEQ ID No. 153) |
| tcgatatggaccagttcatg, | (SEQ ID No. 154) |
| gtcccaagatttagaacctc, | (SEQ ID No. 155) |
| gaacccaaaagccagagtgc, | (SEQ ID No. 156) |
| attcaagagggatctaggg, | (SEQ ID No. 157) |
| aaacataagagagccttggt, | (SEQ ID No. 158) |
| tctacctgcagcacactcga, | (SEQ ID No. 159) |
| tcacaacagaccaaccggcg, | (SEQ ID No. 160) |
| ttccaatttggtgaaagcag, | (SEQ ID No. 161) |
| actctccttgatctatactt, | (SEQ ID No. 162) |
| ccgcgggcagatcctgagca, | (SEQ ID No. 163) |
| caaaatagacatgccgccct, | (SEQ ID No. 164) |
| tgggatttaaaataagctta, | (SEQ ID No. 165) |
| cagacttgagtcacaacaga, | (SEQ ID No. 166) |
| ttggatgcggccattgctt, | (SEQ ID No. 167) |
| ctacgtccactttacattga, | (SEQ ID No. 168) |
| ggaggtgatttccatctaca, | (SEQ ID No. 169) |
| ccttggttcatcagtgttaa, | (SEQ ID No. 170) |
| acgaacccaaagggtacaat, | (SEQ ID No. 171) |

-continued

| | |
|---|---|
| attgatttcaagagggatct, | (SEQ ID No. 172) |
| ctgcctacgtccactttaca, | (SEQ ID No. 173) |
| caagagcagaaggcgaatgg, | (SEQ ID No. 174) |
| tcaagtccaaagatttaaca, | (SEQ ID No. 175) |
| aaatagacatgccgcccttc, | (SEQ ID No. 176) |
| acactcagcacagcagggtc, | (SEQ ID No. 177) |
| tgaaaaggcggtactagttc, | (SEQ ID No. 178) |
| gttcatgcgcaagaggatcg, | (SEQ ID No. 179) |
| atctcttcccttttggccgg, | (SEQ ID No. 180) |
| taatagccactcgtctcttt, | (SEQ ID No. 181) |
| ccgtattaatatttccactt, | (SEQ ID No. 182) |
| caaacaactctccttgatct, | (SEQ ID No. 183) |
| ctgtctgcccagttgttaca, | (SEQ ID No. 184) |
| tgcccagttgttacaacacc, | (SEQ ID No. 185) |
| tcccaggtgctctgtgggta, | (SEQ ID No. 186) |
| gatgataatgatgatgacga, | (SEQ ID No. 187) |
| gctatgcaataggcacccTT, | (SEQ ID No. 188) |
| ctcttagagttaacagtgag, | (SEQ ID No. 189) |
| gtggagaccaaatactttgc, | (SEQ ID No. 190) |
| gaaagtctgcattaagataa, | (SEQ ID No. 191) |
| ctaaggaagcttcttgtaag, | (SEQ ID No. 192) |
| gcaagctgaagctcaccagt, | (SEQ ID No. 193) |
| tagggtggaaatggatacac, | (SEQ ID No. 194) |
| caatgccaacttctgtgctg, | (SEQ ID No. 195) |
| aagcatctgcttctccttgc, | (SEQ ID No. 196) |
| cagctaaaattcttggaaaa, | (SEQ ID No. 197) |
| gatgatgcttgtaacaagaa, | (SEQ ID No. 198) |
| aaactcctagctgtctgccc, | (SEQ ID No. 199) |
| gggtaccttggtgagtacac, | (SEQ ID No. 200) |
| cggcctcccaaagtgctggg, | (SEQ ID No. 201) |
| tgggattacaggcgtgagcc, | (SEQ ID No. 202) |
| tgtatagccatcaccactat, | (SEQ ID No. 203) |
| acactgaactccatttcttc, | (SEQ ID No. 204) |
| cctctcccttccaggagaaa, | (SEQ ID No. 205) |
| gttgggaacgcgttgcattt, | (SEQ ID No. 206) |
| ccgctctgagaattactagt, | (SEQ ID No. 207) |
| ctgagaattactagtttctt, | (SEQ ID No. 208) |
| tttaaaaacatgcactactg, | (SEQ ID No. 209) |
| atgcactactgtgtgctgag, | (SEQ ID No. 210) |
| gcgctcagtctgtctacctg, | (SEQ ID No. 211) |
| atgcgcaagaggatcgaggc, | (SEQ ID No. 212) |
| agaggatcgaggccatccgc, | (SEQ ID No. 213) |
| atccgcgggcagatcctgag, | (SEQ ID No. 214) |
| cccggaagactatccggagc, | (SEQ ID No. 215) |
| cccggaggtgatttccatct, | (SEQ ID No. 216) |
| aggtgatttccatctacaac, | (SEQ ID No. 217) |
| tccatctacaacagtaccag, | (SEQ ID No. 218) |
| aagccgagggcagccgcct, | (SEQ ID No. 219) |
| agtactacgccaaggaggtt, | (SEQ ID No. 220) |
| gccaaggaggtttataaaat, | (SEQ ID No. 221) |
| tttataaaatcgacatgccg, | (SEQ ID No. 222) |
| cctccgaaaatgccatcccg, | (SEQ ID No. 223) |
| ccactttctacagaccctac, | (SEQ ID No. 224) |
| tttctacagaccctacttca, | (SEQ ID No. 225) |
| tacagaccctacttcagaat, | (SEQ ID No. 226) |
| tacttcagaatcgtccgctt, | (SEQ ID No. 227) |
| cacaaagacaggaacctggg, | (SEQ ID No. 228) |
| taaaataagtttacactgcc, | (SEQ ID No. 229) |
| tgcaggtattgatggcacct, | (SEQ ID No. 230) |
| ccagtggtgatcagaaaact, | (SEQ ID No. 231) |
| tggtgatcagaaaactataa, | (SEQ ID No. 232) |
| cctgctaatgttgttgccct, | (SEQ ID No. 233) |
| gccctoctacagactggagt, | (SEQ ID No. 234) |
| tgctttagaaatgtgcagga, | (SEQ ID No. 235) |
| tgccttcgccctcttacat, | (SEQ ID No. 236) |
| gattttaagagggatcttgg, | (SEQ ID No. 237) |
| tggatccatgaacccaaagg, | (SEQ ID No. 238) |
| gaacccaaagggtacaatgc, | (SEQ ID No. 239) |
| tacaatgctaacttctgtgc, | (SEQ ID No. 240) |
| ccttgctgtgtgtcccagga, | (SEQ ID No. 241) |
| gtcttgtaaatgcagctaaa, | (SEQ ID No. 242) |
| aaatgcagctaaagtccttg, | (SEQ ID No. 243) |
| aaaatcacggtgacaatgac, | (SEQ ID No. 244) |
| gttctgtttgttaaaactgg, | (SEQ ID No. 245) |
| gtttgttaaaactggcatct, | (SEQ ID No. 246) |
| tgtgttactatataatgaac, | (SEQ ID No. 247) |
| acctttcattacccttggaa, | (SEQ ID No. 248) |
| aaactcatggatggcttaag, | (SEQ ID No. 249) |
| aattgtaaatggttctttgc, | (SEQ ID No. 250) |
| tctttgccagtttaagcaag, | (SEQ ID No. 251) |
| acagtaactactttacatgt, | (SEQ ID No. 252) |

-continued

| | |
|---|---|
| ctactttacatgtaatgtgt, | (SEQ ID No. 253) |
| catgtaatgtgtagatctta, | (SEQ ID No. 254) |
| gctggccagtacctttgaat, | (SEQ ID No. 255) |
| ctttgcaggctgattaaaaa, | (SEQ ID No. 256) |
| aactgtctgcccagttgtta, | (SEQ ID No. 257) |
| tctgcccagttgttacaaca, | (SEQ ID No. 258) |
| acagtcccaggtgctctgtg, | (SEQ ID No. 259) |
| cccaggtgctctgtgggtac, | (SEQ ID No. 260) |
| gtgctctgtgggtaccttga, | (SEQ ID No. 261) |
| ctgtgggtaccttgatgcca, | (SEQ ID No. 262) |
| taccttgatgccatcccgcc, | (SEQ ID No. 263) |
| ttccaccattagcacgcggg, | (SEQ ID No. 264) |
| ccgtgaccagatgcaggatc, | (SEQ ID No. 265) |
| cccggagggcggcatgggga, | (SEQ ID No. 266) |
| cctcagggagaagggcgc, | (SEQ ID No. 267) |
| gtaggagggcctcgaggg, | (SEQ ID No. 268) |
| ctgcaggggctggggtc, | (SEQ ID No. 269) |
| agggctggtgtggtgggg, | (SEQ ID No. 270) |
| ggcatggggaggcggcg, | (SEQ ID No, 271) |
| ccggagggcggcatgggg, | (SEQ ID No. 272) |
| gggggctggcgagccgc, | (SEQ ID No. 273) |
| ggacaggatctggccgcggatgg, | (SEQ ID No. 274) |
| cccccctggctcgggggc, | (SEQ ID No. 275) |
| gggccgggcggcacctcc, | (SEQ ID No. 276) |
| gggcagcgggccgggcgg, | (SEQ ID No. 277) |
| acggcctcgggcagcggg, | (SEQ ID No. 278) |
| gggtgctgttgtacaggg, | (SEQ ID No. 279) |
| gggtttccaccattagcacgcggg, | (SEQ ID No. 280) |
| tcatagatttcgtt, | (SEQ ID No. 281) |
| ttgtcatagattt, | (SEQ ID No. 282) |
| aagaacatatatatg, | (SEQ ID No. 283) |
| aagaacatatatat, | (SEQ ID No. 284) |
| ttgaagaacatatata, | (SEQ ID No. 285) |
| ccgggagagcaacacggg, | (SEQ ID No. 286) |
| acttttaacttga, | (SEQ ID No. 287) |
| attgttgctgtattt, | (SEQ ID No. 288) |
| attgttgctgtatt, | (SEQ ID No. 289) |
| aattgttgctgtatt, | (SEQ ID No. 290) |
| aattgttgctgtat, | (SEQ ID No. 291) |
| ggcgagtcgctgggtgccagcagccgg, | (SEQ ID No. 292) |
| ggcgagtcgctggg, | (SEQ ID No. 293) |
| acatcaaaagataa, | (SEQ ID No. 294) |
| tgacatcaaaagat, | (SEQ ID No. 295) |
| gggccctctccagcgggg, | (SEQ ID No. 296) |
| gggctcggcggtgccggg, | (SEQ ID No. 297) |
| ggggcagggcccgaggca, | (SEQ ID No. 298) |
| ggctccaaatgtagggc, | (SEQ ID No. 299) |
| cgggttatgctggttgtacagggc, | (SEQ ID No. 300) |
| cggcgccgccgaggcgcccggg, | (SEQ ID No. 301) |
| ggggcggggcgggacc, | (SEQ ID No. 302) |
| gggcggggcggggcgggg, | (SEQ ID No. 303) |
| gggcggggtggggccggg, | (SEQ ID No. 304) |
| gggcaaggcagcggggcgggg, | (SEQ ID No. 305) |
| cggtagcagcagcg, | (SEQ ID No. 306) |
| ccagtagccacagc, | (SEQ ID No. 307) |
| gcaggtggatagtcc, | (SEQ ID No. 308) |
| cttgcaggtggatag, | (SEQ ID No. 309) |
| cgatagtcttgcagg, | (SEQ ID No. 310) |
| ccatgtcgatagtcttgc, | (SEQ ID No. 311) |
| ctcgatgcgcttccg, | (SEQ ID No. 312) |
| cctcgatgcgcttcc, | (SEQ ID No. 313) |
| ggatggcctcgatgc, | (SEQ ID No. 314) |
| ggacaggatctggcc, | (SEQ ID No. 315) |
| cgcagcttggacagg, | (SEQ ID No. 316) |
| gagccgcagcttgg, | (SEQ ID No. 317) |
| cgagccgcagcttg, | (SEQ ID No. 318) |
| acctcccctggct, | (SEQ ID No. 319) |
| ccaccattagcacg, | (SEQ ID No. 320) |
| gaacttgtcatagatttc, | (SEQ ID No. 321) |
| gctgtgtgtactctgc, | (SEQ ID No. 322) |
| gctccacgtgctgc, | (SEQ ID No. 323) |
| gaattgttgctgtatttc, | (SEQ ID No. 324) |
| gccaggaattgttgc, | (SEQ ID No. 325) |
| gtgacatcaaaagataac, | (SEQ ID No. 326) |
| ggctcaaccactgcc, | (SEQ ID No. 327) |
| gctgtcacaggagc, | (SEQ ID No. 328) |
| cctgctgtcacagg, | (SEQ ID No. 329) |
| gcagtgtgttatccctgc, | (SEQ ID No. 330) |
| gcagtgtgttatccc, | (SEQ ID No. 331) |
| ccaggtcacctcgg, | (SEQ ID No. 332) |
| gccatgaatggtggc, | (SEQ ID No. 333) |

-continued

| | |
|---|---|
| gccatgaatggtgg, | (SEQ ID No. 334) |
| ccatgagaagcagg, | (SEQ ID No. 335) |
| ggaagtcaatgtacagc, | (SEQ ID No. 336) |
| ccacgtagtacacgatgg, | (SEQ ID No. 337) |
| gcacttgcaggagc, | (SEQ ID No. 338) |
| ccatggcagtgacc, | (SEQ ID No. 339) |
| ggctcctccatggc, | (SEQ ID No. 340) |
| gctaggatctgactgc, | (SEQ ID No. 341) |
| cctgactcagaggg, | (SEQ ID No. 342) |
| ggtctgaaaatgtttcc, | (SEQ ID No. 343) |
| ccattgcttgggacgg, | (SEQ ID No. 344) |
| gcatcaaatcatcc, | (SEQ ID No. 345) |
| ccattgttcaatatcg, | (SEQ ID No. 346) |
| ggtcttcagtgaacc, | (SEQ ID No. 347) |
| ggagcttcatctggacc, | (SEQ ID No. 348) |
| cctctggcattctgg, | (SEQ ID No. 349) |
| agggacagaagatg, | (SEQ ID No. 350) |
| gttttctgggaagg, | (SEQ ID No. 351) |
| ggttttctgggaag | (SEQ ID No. 352) |
| aggttttctgggaag, | (SEQ ID No. 353) |
| gtaggttttctggg, | (SEQ ID No. 354) |
| ggtaggttttctgg, | (SEQ ID No. 355) |
| ccagaatgcaagaagcc, | (SEQ ID No. 356) |
| gctgtcccagaatgc, | (SEQ ID No. 357) |
| gcaagtcacagacttggc, | (SEQ ID No. 358) |
| ccacagctgcacagg, | (SEQ ID No. 359) |
| ggtgtggaatcaacc, | (SEQ ID No. 360) |
| gtcatgtgctgtga, | (SEQ ID No. 361) |
| cgctatctgagcagcg, | (SEQ ID No. 362) |
| ccagtgtgatgatgg, | (SEQ ID No. 363) |
| ccagtagattaccactgg, | (SEQ ID No. 364) |
| ggcacaaacacgcacc, | (SEQ ID No. 365) |
| ccacggatctgaagg, | (SEQ ID No. 366) |
| cggaacatctcgaagcg, | (SEQ ID No. 367) |
| cctcattcagctctcgg, | (SEQ ID No. 368) |
| ccttgagttccaagg, | (SEQ ID No. 369) |
| cctttttggacttcagg, | (SEQ ID No. 370) |
| ggaggtagactgaccc, | (SEQ ID No. 371) |
| aaaatgtttcct, | (SEQ ID No. 372) |
| tgaaaatgtttc, | (SEQ ID No. 373) |
| ctgaaaatgttt, | (SEQ ID No. 374) |
| tctgaaaatgttt, | (SEQ ID No. 375) |
| tctgaaaatgtt, | (SEQ ID No. 376) |
| aaatcatccatt, | (SEQ ID No. 377) |
| ttgttcaatatc, | (SEQ ID No. 378) |
| attgttcaatatc, | (SEQ ID No. 379) |
| attgttcaatat, | (SEQ ID No. 380) |
| cattgttcaatat, | (SEQ ID No. 381) |
| cattgttcaata, | (SEQ ID No. 382) |
| aaaagtgtttct, | (SEQ ID No. 383) |
| acatgagtttttat, | (SEQ ID No. 384) |
| aacatgagtttttat, | (SEQ ID No. 385) |
| acatgagtttttta, | (SEQ ID No. 386) |
| aacatgagtttttta, | (SEQ ID No. 387) |
| aacatgagtttttt, | (SEQ ID No. 388) |
| aaaacatcttgtt, | (SEQ ID No. 389) |
| cagaggggctcgacgc, | (SEQ ID No. 390) |
| ctgactcagagggggctc, | (SEQ ID No. 391) |
| aggggggacagaacg, | (SEQ ID No. 392) |
| ttgggacggcaaggggacagaa, | (SEQ ID No. 393) |
| tgggacggcaaggggga, | (SEQ ID No. 394) |
| gccacgggggagca, | (SEQ ID No. 395) |
| gcagggccacggggggag, | (SEQ ID No. 396) |
| aggggccacggggg, | (SEQ ID No. 397) |
| caggggccacgggg, | (SEQ ID No. 398) |
| ggtgcaggggccacg, | (SEQ ID No. 399) |
| tggtgcaggggccgccgg, | (SEQ ID No. 400) |
| ggggctggtgcaggggcc, | (SEQ ID No. 401) |
| aggggctggtgcagggg, | (SEQ ID No. 402) |
| gggctggtgcaggg, | (SEQ ID No. 403) |
| gaggggctggtgcag, | (SEQ ID No. 404) |
| aggaggggctggtg, | (SEQ ID No. 405) |
| gggccaggaggggctgg, | (SEQ ID No. 406) |
| aggggccaggaggggct, | (SEQ ID No. 407) |
| ggggccaggagggg, | (SEQ ID No. 408) |
| caggggccaggaggg, | (SEQ ID No. 409) |
| tctgggaagggacaga, | (SEQ ID No. 410) |
| tgagggcagggagta, | (SEQ ID No. 411) |
| ttgagggcaggggag, | (SEQ ID No. 412) |
| cgggtgccgggcgggggtg, | (SEQ ID No. 413) |
| cggacgcgggtgccgggcggggt, | (SEQ ID No. 414) |

-continued

| | |
|---|---|
| cgggtgccgggcggg, | (SEQ ID No. 415) |
| ggacgcgggtgccgggcg, | (SEQ ID No. 416) |
| tgggggcagcgcctcaca, | (SEQ ID No. 417) |
| ggtggggcagcgcct, | (SEQ ID No. 418) |
| ccattttagtgcacatccgg, | (SEQ ID No. 419) |
| ccattttagtgcacatcc, | (SEQ ID No. 420) |
| gctgttccattttagtgc, | (SEQ ID No. 421) |
| gtagtcgtgtagag, | (SEQ ID No. 422) |
| gtttgtagtcgtgtag, | (SEQ ID No. 423) |
| gtttcaggagtttgtag, | (SEQ ID No. 424) |
| ccagctccgaagagg, | (SEQ ID No. 425) |
| cgtcgtcgtgatcacg, | (SEQ ID No. 426) |
| ggtaaaagtactgtcc, | (SEQ ID No. 427) |
| ggctttgacaaagcc, | (SEQ ID No. 428) |
| cttgtgcagatcgtccag, | (SEQ ID No. 429) |
| cgtggttcatcttgtc, | (SEQ ID No. 430) |
| cacgtggttcatcttgtg, | (SEQ ID No. 431) |
| cctccttgaaggtgg, | (SEQ ID No. 432) |
| cgctccactttgatgcg, | (SEQ ID No. 433) |
| ccttgtcctccagg, | (SEQ ID No. 434) |
| ggtactcgacagcc, | (SEQ ID No. 435) |
| ctgacgtgggtcatg, | (SEQ ID No. 436) |
| ccgttgctgacgtgg, | (SEQ ID No. 437) |
| catcctccgcctcc, | (SEQ ID No. 438) |
| gtttccatcctccg, | (SEQ ID No. 439) |
| ggtgtttccatcctcc, | (SEQ ID No. 440) |
| ggtgtttccatcctc, | (SEQ ID No. 441) |
| gctcagcgcctcatc, | (SEQ ID No. 442) |
| ccttcttcatcatgctgc, | (SEQ ID No. 443) |
| ccttcttcatcatgctg, | (SEQ ID No. 444) |
| ccttcttcatcatgc, | (SEQ ID No. 445) |
| gcgtccttcttcatcatgc, | (SEQ ID No. 446) |
| cctgctcactcagg, | (SEQ ID No. 447) |
| cgcaggcttgagcg, | (SEQ ID No. 448) |
| gccagcttcagcagc, | (SEQ ID No. 449) |
| ggtggtgaccagcc, | (SEQ ID No. 450) |
| cctcggcgaactcc, | (SEQ ID No. 451) |
| gcttgtgtaaatcc, | (SEQ ID No. 452) |
| ggttctgcttgtgtaaatcc, | (SEQ ID No. 453) |
| gctgctcaggttcgc, | (SEQ ID No. 454) |
| gaaggcgaccgtcg, | (SEQ ID No. 455) |
| cgaaggcgaccgtc, | (SEQ ID No. 456) |
| gcaccgtctgtggc, | (SEQ ID No. 457) |
| cgtgtccatgtcgatgg, | (SEQ ID No. 458) |
| cgtgtccatgtcgatg, | (SEQ ID No. 459) |
| gcgtgtccatgtcg, | (SEQ ID No. 460) |
| ccagcttgcgcttgc, | (SEQ ID No. 461) |
| cgctccagcttgcg, | (SEQ ID No. 462) |
| cgtgttctgactcttgag, | (SEQ ID No. 463) |
| cgtgttctgactcttg, | (SEQ ID No. 464) |
| gctgttgacgtggc, | (SEQ ID No. 465) |
| cgactcagtacgcc, | (SEQ ID No. 466) |
| gccatgcccgactc, | (SEQ ID No. 467) |
| cccttggaggtggc, | (SEQ ID No. 468) |
| ttttagtgcacat, | (SEQ ID No. 469) |
| tgttccattttagt, | (SEQ ID No. 470) |
| aaaaaaagtggaag, | (SEQ ID No. 471) |
| tacaaaaaaagtg, | (SEQ ID No. 472) |
| atacaaaaaaagt, | (SEQ ID No. 473) |
| catacaaaaaaagt, | (SEQ ID No. 474) |
| catacaaaaaaag, | (SEQ ID No. 475) |
| gaaaaaaacatac, | (SEQ ID No. 476) |
| cagaaaaaaacatac, | (SEQ ID No. 477) |
| cagaaaaaaacat, | (SEQ ID No. 478) |
| ttcaatatgaatcg, | (SEQ ID No. 479) |
| tattcaatatgaatcg, | (SEQ ID No. 480) |
| tattcaatatgaatc, | (SEQ ID No. 481) |
| tattcaatatgaat, | (SEQ ID No. 482) |
| tatattcaatatgaa, | (SEQ ID No. 483) |
| ttatattcaatatga, | (SEQ ID No. 484) |
| tattatattcaatatga, | (SEQ ID No. 485) |
| ttatattcaatatg, | (SEQ ID No. 486) |
| tattatattcaatatg, | (SEQ ID No. 487) |
| attatattcaatat, | (SEQ ID No. 488) |
| tattatattcaatat, | (SEQ ID No. 489) |
| atatattatattcaatat, | (SEQ ID No. 490) |
| aaatatattatattcaatat, | (SEQ ID No. 491) |
| tattatattcaata, | (SEQ ID No. 492) |
| atatattatattcaata, | (SEQ ID No. 493) |
| caaatatattatattcaata, | (SEQ ID No. 494) |
| tatattatattcaat, | (SEQ ID No. 495) |

-continued

| | |
|---|---|
| aatatattatattcaat, | (SEQ ID No. 496) |
| tatattatattcaa, | (SEQ ID No. 497) |
| caaatatattatattcaa, | (SEQ ID No. 498) |
| caaatatattatattca, | (SEQ ID No. 499) |
| caaatatattatattc, | (SEQ ID No. 500) |
| cacaaatatattatattc, | (SEQ ID No. 501) |
| aaatatattatatt, | (SEQ ID No. 502) |
| caaatatattatatt, | (SEQ ID No. 503) |
| caaatatattatat, | (SEQ ID No. 504) |
| cacaaatatattatat, | (SEQ ID No. 505) |
| cacaaatatattat, | (SEQ ID No. 506) |
| tacacaaatatattat, | (SEQ ID No. 507) |
| tacacaaatatatta, | (SEQ ID No. 508) |
| taaatacacaaatatatt, | (SEQ ID No. 509) |
| aatacacaaatata, | (SEQ ID No. 510) |
| gttaaatacacaaata, | (SEQ ID No. 511) |
| tgttaaatacacaa, | (SEQ ID No. 512) |
| tttagagactaagt, | (SEQ ID No. 513) |
| ataaactctttaga, | (SEQ ID No. 514) |
| taaaataaactctttag, | (SEQ ID No. 515) |
| taaaataaactcttta, | (SEQ ID No. 516) |
| ttaaaataaactcttt, | (SEQ ID No. 517) |
| cttaaaataaactc, | (SEQ ID No. 518) |
| taaaagaacaaaca, | (SEQ ID No. 519) |
| taaaagaacaaac, | (SEQ ID No. 520) |
| caataaaaagaacaa, | (SEQ ID No. 521) |
| tcaataaaaagaacaa, | (SEQ ID No. 522) |
| tcaataaaaagaac, | (SEQ ID No. 523) |
| ttcaataaaaagaa, | (SEQ ID No. 524) |
| tagattcaataaaaga, | (SEQ ID No. 525) |
| tggcgcgggcgggtagc, | (SEQ ID No. 526) |
| gggctggcgcgggcgggtag, | (SEQ ID No. 527) |
| tcggggctggcgcgggcggg, | (SEQ ID No. 528) |
| tgggtgcctggtcgcgcgttctcggg, | (SEQ ID No. 529) |
| aggtccctgcgggccg, | (SEQ ID No. 530) |
| gggagggtccctgcgggg, | (SEQ ID No. 531) |
| gggagggtccctgcgg, | (SEQ ID No. 532) |
| tgggccgggtccgc, | (SEQ ID No. 533) |
| tcccgggggtgtag, | (SEQ ID No. 534) |
| agtactgtcccgggggtgt, | (SEQ ID No. 535) |
| gggacacgttgggggggtg, | (SEQ ID No. 536) |
| gccgggggcccccggtagc, | (SEQ ID No. 537) |
| cgggcccagccgggggc, | (SEQ ID No. 538) |
| cgggcccagccggg, | (SEQ ID No. 539) |
| gggaggtggctccgggccgg, | (SEQ ID No. 540) |
| agggcggcgcgtgtggga, | (SEQ ID No. 541) |
| gggtggccaccggcgaaggg, | (SEQ ID No. 542) |
| aggggcaggggacgt, | (SEQ ID No. 543) |
| taaaggggcaggggacgt, | (SEQ ID No. 544) |
| aggggggtgtccgtaaaggg, | (SEQ ID No. 545) |
| ggggacgcgaacgtgccgccg, | (SEQ ID No. 546) |
| cggggaacaagcggcccgggg, | (SEQ ID No. 547) |
| ggccgtcgggggcg, | (SEQ ID No. 548) |
| gcggccgtcgggggc, | (SEQ ID No. 549) |
| agggggggtaggaggcggg, | (SEQ ID No. 550) |
| gcgctgggggcgcc, | (SEQ ID No. 551) |
| ggccgtcgggggt, | (SEQ ID No. 552) |
| ggggaggccagcttc, | (SEQ ID No. 553) |
| ggccgccaccttgggg, | (SEQ ID No. 554) |
| gcggccgccgccgggg, | (SEQ ID No. 555) |
| gggcgcggccgccgccgggg, | (SEQ ID No. 556) |
| ggggtggcggcggcgg, | (SEQ ID No. 557) |
| ggggtggcggcggc, | (SEQ ID No. 558) |
| tggggcagcagctggcag, | (SEQ ID No. 559) |
| cggggcgcccacgacacc, | (SEQ ID No. 560) |
| cggggcgcccacgacac, | (SEQ ID No. 561) |
| gggccgcaccctctccaagtccgggg, | (SEQ ID No. 562) |
| gcagcagtcagtgg, | (SEQ ID No. 563) |
| ccattgtctagcacgg, | (SEQ ID No. 564) |
| ggtctccattgtctagc, | (SEQ ID No. 565) |
| ggtggtattgttcagc, | (SEQ ID No. 566) |
| gctggatcaagaccc, | (SEQ ID No. 567) |
| ccacaaaatcgtgtcc, | (SEQ ID No. 568) |
| ccttccacaaaatcgtgtcc, | (SEQ ID No. 569) |
| ggttgttcttgtgg, | (SEQ ID No. 570) |
| cctcttggttgtgc, | (SEQ ID No. 571) |
| ccagagtctcaaacacttgg, | (SEQ ID No. 572) |
| ggtaacctgtgatctcttcc, | (SEQ ID No. 573) |
| cctgcagtactcgg, | (SEQ ID No. 574) |
| ggcattcacatactcc, | (SEQ ID No. 575) |
| gcaaacagtgcctggc, | (SEQ ID No. 576) |

| Sequence | ID |
|---|---|
| cgcatcgtgtacttccg, | (SEQ ID No. 577) |
| gcacgttccgagcg, | (SEQ ID No. 578) |
| ggtaccagatactcc, | (SEQ ID No. 579) |
| ccagtggagacctgg, | (SEQ ID No. 580) |
| cctgaggacacatcagg, | (SEQ ID No. 581) |
| cctcacttggttgtgagc, | (SEQ ID No. 582) |
| ggaagatgtccttcc, | (SEQ ID No. 583) |
| gcacactgctcatggc, | (SEQ ID No. 584) |
| gctgtcacctcttgg, | (SEQ ID No. 585) |
| cctctgctgtcacc, | (SEQ ID No. 586) |
| ccacacatcactctgg, | (SEQ ID No. 587) |
| cctcctcttcagagg, | (SEQ ID No. 588) |
| ccttctggttcacactgg, | (SEQ ID No. 589) |
| catggtgctcactgcg, | (SEQ ID No. 590) |
| cttggttgtgagcg, | (SEQ ID No. 591) |
| ggacaggcagtcac, | (SEQ ID No. 592) |
| gtcacctcttggttgtgc, | (SEQ ID No. 593) |
| ccagagtctcaaacac, | (SEQ ID No. 594) |
| cacatactccctgg, | (SEQ ID No. 595) |
| gaccagcacgttccg, | (SEQ ID No. 596) |
| gttggtgtctatcagtg, | (SEQ ID No. 597) |
| ccctggtagaggtg, | (SEQ ID No. 598) |
| ctcaaacacttggagc, | (SEQ ID No. 599) |
| cacacatcactctggtgg, | (SEQ ID No. 600) |
| gcacagacagtgcgc, | (SEQ ID No. 601) |
| catggcagcagtcag, | (SEQ ID No. 602) |
| ctgctcatggcagcag, | (SEQ ID No. 603) |
| catctggaaacttccagatg, | (SEQ ID No. 604) |
| ctggaaacttccag, | (SEQ ID No. 605) |
| cataactccacacatcactc, | (SEQ ID No. 606) |
| caccataactccacacatc, | (SEQ ID No. 607) |
| ctggtgggtgaacc, | (SEQ ID No. 608) |
| cggattacttgcagg, | (SEQ ID No. 609) |
| cgctaggtgtcagcg, | (SEQ ID No. 610) |
| gccatcacgtatgc, | (SEQ ID No. 611) |
| gcataccagttcagc, | (SEQ ID No. 612) |
| ccatcaaatacatcgg, | (SEQ ID No. 613) |
| ccagcagaagtcagg, | (SEQ ID No. 614) |
| gcttcatgtctgtgc, | (SEQ ID No. 615) |
| ggtgagttccaggtttcc, | (SEQ ID No. 616) |
| ccacaaaatcgtgtcctgg, | (SEQ ID No. 617) |
| cccttacacatcgg, | (SEQ ID No. 618) |
| gcagctcacagatgc, | (SEQ ID No. 619) |
| gcactggtaactgc, | (SEQ ID No. 620) |
| cctggatattggcactgg, | (SEQ ID No. 621) |
| ccagcaaactcctgg, | (SEQ ID No. 622) |
| gcagaaatgccaggc, | (SEQ ID No. 623) |
| ccattgtgcagaattcg, | (SEQ ID No. 624) |
| ccctgcagtactcgg, | (SEQ ID No. 625) |
| ggcattcacatactccc, | (SEQ ID No. 626) |
| ggtcaggtttcacacc, | (SEQ ID No. 627) |
| ccaggtccacacagg, . | (SEQ ID No. 628) |
| ccttgtcatccagg, | (SEQ ID No. 629) |
| ggatcccaaagacc, | (SEQ ID No. 630) |
| cctcaacactttgatgg, | (SEQ ID No. 631) |
| gctgtgtcaccagc, | (SEQ ID No. 632) |
| ggtctaagaggcagcc, | (SEQ ID No. 633) |
| ggcaatctgcatacacc, | (SEQ ID No. 634) |
| cctgtgtacgagcc, | (SEQ ID No. 635) |
| ccatccacttgatgg, | (SEQ ID No. 636) |
| cccacacagtcacacc, | (SEQ ID No. 637) |
| ccatcgtaaggtttgg, | (SEQ ID No. 638) |
| cctttttccagcagg, | (SEQ ID No. 639) |
| ggagaattcagacacc, | (SEQ ID No. 640) |
| ccaagtcctcattctgg, | (SEQ ID No. 641) |
| ccatcagtctcagagg, | (SEQ ID No. 642) |
| cctttgaaggtgctgg, | (SEQ ID No. 643) |
| ggcatggcaggttcc, | (SEQ ID No. 644) |
| cctggcatggcagg, | (SEQ ID No. 645) |
| agatgtataggtaa, | (SEQ ID No. 646) |
| attttcacattctc, | (SEQ ID No. 647) |
| aattttcacattctc, | (SEQ ID No. 648) |
| aattttcacattct, | (SEQ ID No. 649) |
| gaattttcacattc, | (SEQ ID No. 650) |
| ggaattttcacatt, | (SEQ ID No. 651) |
| agatttctttgttg, | (SEQ ID No. 652) |
| aagatttctttgttg, | (SEQ ID No. 653) |
| aagatttctttgtt, | (SEQ ID No. 654) |
| taagatttctttgtt, | (SEQ ID No. 655) |
| ctaagatttctttgtt, | (SEQ ID No. 656) |
| taagatttctttgt, | (SEQ ID No. 657) |

| | |
|---|---|
| ctaagatttctttgt, | (SEQ ID No. 658) |
| ctaagatttctttg, | (SEQ ID No. 659) |
| tctaagatttcttt, | (SEQ ID No. 660) |
| gtctaagatttcttt, | (SEQ ID No. 661) |
| gtctaagatttctt, | (SEQ ID No. 662) |
| ttcgtctaagattt, | (SEQ ID No. 663) |
| attttgacatggtt, | (SEQ ID No. 664) |
| aattttgacatggtt, | (SEQ ID No. 665) |
| aattttgacatggt, | (SEQ ID No. 666) |
| taattttgacatggt, | (SEQ ID No. 667) |
| taattttgacatgg, | (SEQ ID No. 668) |
| gtaattttgacatg, | (SEQ ID No. 669) |
| tgtaattttgacatg, | (SEQ ID No. 670) |
| tgtaattttgacat, | (SEQ ID No. 671) |
| tctgtaattttgacat, | (SEQ ID No. 672) |
| ctgtaattttgaca, | (SEQ ID No. 673) |
| tctgtaattttgaca, | (SEQ ID No. 674) |
| tctgtaattttgac, | (SEQ ID No. 675) |
| gtctgtaattttga, | (SEQ ID No. 676) |
| aagtctgtaattttga, | (SEQ ID No. 677) |
| agtctgtaattttg, | (SEQ ID No. 678) |
| aagtctgtaattttg, | (SEQ ID No. 679) |
| aagtctgtaatttt, | (SEQ ID No. 680) |
| gaagtctgtaatttt, | (SEQ ID No. 681) |
| gaagtctgtaattt, | (SEQ ID No. 682) |
| atgtagacatcaat, | (SEQ ID No. 683) |
| atcatccaacattt, | (SEQ ID No. 684) |
| aatcatccaacattt, | (SEQ ID No. 685) |
| aatcatccaacatt, | (SEQ ID No. 686) |
| accatcaaatacat, | (SEQ ID No. 687) |
| aaaaacgtctttga, | (SEQ ID No. 688) |
| ttttgttcttagaca, | (SEQ ID No. 689) |
| ttttgttcttagac, | (SEQ ID No. 690) |
| taaacagaaaagca, | (SEQ ID No. 691) |
| actaaacagaaaag, | (SEQ ID No. 692) |
| aaactaaacagaaaag, | (SEQ ID No. 693) |
| aactaaacagaaaa, | (SEQ ID No. 694) |
| aaactaaacagaaaa, | (SEQ ID No. 695) |
| aaactaaacagaaa, | (SEQ ID No. 696) |
| taaaactaaacagaaa, | (SEQ ID No. 697) |
| aaaactaaacagaa, | (SEQ ID No. 698) |
| gtaaaactaaacagaa, | (SEQ ID No. 699) |
| aaaactaaacaga, | (SEQ ID No. 700) |
| taaaactaaacaga, | (SEQ ID No. 701) |
| taaaactaaacag, | (SEQ ID No. 702) |
| gtaaaactaaaca, | (SEQ ID No. 703) |
| aaaagtaaaactaaaca, | (SEQ ID No. 704) |
| agtaaaactaaac, | (SEQ ID No. 705) |
| aaaaaagtaaaactaaac, | (SEQ ID No. 706) |
| aagtaaaactaaa, | (SEQ ID No. 707) |
| aaaaaagtaaaactaaa, | (SEQ ID No. 708) |
| aaagtaaaactaa, | (SEQ ID No. 709) |
| aaaagtaaaaacta, | (SEQ ID No. 710) |
| aaaaaagtaaaaacta, | (SEQ ID No. 711) |
| aaaaagtaaaaact, | (SEQ ID No. 712) |
| aaaaaagtaaaaact, | (SEQ ID No. 713) |
| aaaaaagtaaaaac, | (SEQ ID No. 714) |
| caaaaaagtaaaaac, | (SEQ ID No. 715) |
| aaaaaagtaaaaa, | (SEQ ID No. 716) |
| caaaaaagtaaaa, | (SEQ ID No. 717) |
| aacaaacaaaaaagtaaa, | (SEQ ID No. 718) |
| aaacaaaaaagta, | (SEQ ID No. 719) |
| caaaacaaaaaagta, | (SEQ ID No. 720) |
| caaaacaaaaaagt, | (SEQ ID No. 721) |
| caaaacaaaaaag, | (SEQ ID No. 722) |
| ctttaaaaaacaaaac, | (SEQ ID No. 723) |
| tctttaaaaaacaaa, | (SEQ ID No. 724) |
| gtctttaaaaaacaaa, | (SEQ ID No. 725) |
| gtctttaaaaaaca, | (SEQ ID No. 726) |
| gtctttaaaaaaac, | (SEQ ID No. 727) |
| tttatttcgtcttt, | (SEQ ID No. 728) |
| tctttatttcgtct, | (SEQ ID No. 729) |
| tatttgcaaatgga, | (SEQ ID No. 730) |
| tatatttgcaaatgg, | (SEQ ID No. 731) |
| tatatttgcaaatg, | (SEQ ID No. 732) |
| caaaatatatttgcaaatg, | (SEQ ID No. 733) |
| caaaatatatttgcaaat, | (SEQ ID No. 734) |
| caaaatatatttgca, | (SEQ ID No. 735) |
| caaaatatatttgc, | (SEQ ID No. 736) |
| ttccaaaatatatttg, | (SEQ ID No. 737) |
| ttttccaaaatatattt, | (SEQ ID No. 738) |

| | | | |
|---|---|---|---|
| gttttccaaaatatatt, | (SEQ ID No. 739) | tgaactctagtttttt, | (SEQ ID No. 779) |
| gttttccaaaatat, | (SEQ ID No. 740) | atgaactctagttttt, | (SEQ ID No. 780) |
| ggttaggcaaagcc, | (SEQ ID No. 741) | tgaactctagttttt, | (SEQ ID No. 781) |
| ccgagaacatcatcgtgg, | (SEQ ID No. 742) | atgaactctagtttt, | (SEQ ID No. 782) |
| ccgagaacatcatcgtg, | (SEQ ID No. 743) | atgaactctagttt, | (SEQ ID No. 783) |
| ccgagaacatcatcg, | (SEQ ID No. 744) | gcacacagtagtgc, | (SEQ ID No. 784) |
| cgtagtctgcgttgaagc, | (SEQ ID No. 745) | gcaggatcagaaaagc, | (SEQ ID No. 785) |
| ccatgctggagaagg, | (SEQ ID No. 746) | gcaggtagacaggc, | (SEQ ID No. 786) |
| ccgtgcagaagtcc, | (SEQ ID No. 747) | gcttgctcaggatctgc, | (SEQ ID No. 787) |
| ggaatgaagttggc, | (SEQ ID No. 748) | gcaagtccctggtgc, | (SEQ ID No. 788) |
| tgaccgtgggaatg, | (SEQ ID No. 749) | cctggagcaagtcc, | (SEQ ID No. 789) |
| tggcagtgaccgtg, | (SEQ ID No. 750) | cgtagtactcttcgtcg, | (SEQ ID No. 790) |
| agatggcagtgacc, | (SEQ ID No. 751) | cgtagtactcttcg, | (SEQ ID No. 791) |
| cgagatggcagtgacc, | (SEQ ID No. 752) | gtaaacctccttgg, | (SEQ ID No. 792) |
| ccagccactgcagg, | (SEQ ID No. 753) | gtctattttgtaaacctcc, | (SEQ ID No. 793) |
| gcaccagccactgc, | (SEQ ID No. 754) | gcatgtctattttgtaaacc, | (SEQ ID No. 794) |
| ccctggagtaagcc, | (SEQ ID No. 755) | ggcatcaaggtaccc, | (SEQ ID No. 795) |
| ggagataactgttccacc, | (SEQ ID No. 756) | ggcatcaaggtacc, | (SEQ ID No. 796) |
| ggagataactgttcc, | (SEQ ID No. 757) | gctttcaccaaattggaagc, | (SEQ ID No. 797) |
| cttctagttggtctg, | (SEQ ID No. 758) | gagaatctgatatagctc, | (SEQ ID No. 798) |
| catcttctagttgg, | (SEQ ID No. 759) | ggagatgttaaatctttgg, | (SEQ ID No. 799) |
| tctcatcttctagttgg, | (SEQ ID No. 760) | gctgtcgatgtagc, | (SEQ ID No. 800) |
| ctgcaaagcagacttctc, | (SEQ ID No. 761) | ccaggttcctgtctttatgg, | (SEQ ID No. 801) |
| ccttcagcaggttgg, | (SEQ ID No. 762) | cagcagggacagtg, | (SEQ ID No. 802) |
| cccaggtcatcagg, | (SEQ ID No. 763) | cttgcttctagttcttcac, | (SEQ ID No. 803) |
| ccagtcagatcaagg, | (SEQ ID No. 764) | gccatcaatacctgc, | (SEQ ID No. 804) |
| ggtgaaggcctcctc, | (SEQ ID No. 765) | ggtgccatcaatacc, | (SEQ ID No. 805) |
| cagggtgaaggcctc, | (SEQ ID No. 766) | ccactggtatatgtgg, | (SEQ ID No. 806) |
| cctggatgatgctgg, | (SEQ ID No. 767) | ggactttatagttttctg, | (SEQ ID No. 807) |
| ccactgtgcagagg, | (SEQ ID No. 768) | ctcaagtctgtaggag, | (SEQ ID No. 808) |
| ggagtacaggtgacc, | (SEQ ID No. 769) | ggtctgttgtgactc, | (SEQ ID No. 809) |
| gctcattgctgctgc, | (SEQ ID No. 770) | caattatcctgcacatttc, | (SEQ ID No. 810) |
| ggaaggctcattgctgc, | (SEQ ID No. 771) | gcagcaattatcctgc, | (SEQ ID No. 811) |
| tttctcttcttct, | (SEQ ID No. 772) | ggcagcaattatcc, | (SEQ ID No. 812) |
| atcttattcctttc, | (SEQ ID No. 773) | ggttcgtgtatccatttcc, | (SEQ ID No. 813) |
| catcttattcctttt, | (SEQ ID No. 774) | gcacagaagttggc, | (SEQ ID No. 814) |
| tagttttccttct, | (SEQ ID No. 775) | ccagcacagaagttgg, | (SEQ ID No. 815) |
| tctagttttccttt, | (SEQ ID No. 776) | gtgctgagtgtctg, | (SEQ ID No. 816) |
| aactctagttttc, | (SEQ ID No. 777) | cctgctgtgctgagtg, | (SEQ ID No. 817) |
| gaactctagtttttt, | (SEQ ID No. 778) | gctcaggaccctgc, | (SEQ ID No. 818) |
| | | gcagcaaggagaagc, | (SEQ ID No. 819) |

-continued

| | |
|---|---|
| ccaatgtagtagagaatgg, | (SEQ ID No. 820) |
| gctgcatttgcaag, | (SEQ ID No. 821) |
| aaaaaagaaatcaa, | (SEQ ID No. 822) |
| aaaaaaagaaatcaa, | (SEQ ID No. 823) |
| aaaaaaaagaaatcaa, | (SEQ ID No. 824) |
| taaaaaaaagaaatcaa, | (SEQ ID No. 825) |
| ataaaaaaaagaaatcaa, | (SEQ ID No. 826) |
| aataaaaaaaagaaatcaa, | (SEQ ID No. 827) |
| gaataaaaaaagaaat, | (SEQ ID No. 828) |
| agaataaaaaaagaaat, | (SEQ ID No. 829) |
| cagaataaaaaaa, | (SEQ ID No. 830) |
| tcagaataaaaaaa, | (SEQ ID No. 831) |
| ttgttttttaaaagt, | (SEQ ID No. 832) |
| agttgttttttaaaa, | (SEQ ID No. 833) |
| aagttgttttttaaaa, | (SEQ ID No. 834) |
| aaagttgttttttaaaa, | (SEQ ID No. 835) |
| aaaagttgttttttaaaa, | (SEQ ID No. 836) |
| aaaaagttgttttttaaaa, | (SEQ ID No. 837) |
| aaaaaagttgttttttaaaa, | (SEQ ID No. 838) |
| aaaaaaagttgttttttaaaa, | (SEQ ID No. 839) |
| aaaaaaaagttgttttttaaa, | (SEQ ID No. 840) |
| tttttaaaaaagtg, | (SEQ ID No. 841) |
| tttttttaaaaaagtg, | (SEQ ID No. 842) |
| atttttttaaaaaagtg, | (SEQ ID No. 843) |
| cattttttaaaaaagt, | (SEQ ID No. 844) |
| gcatttttttaaaaaa, | (SEQ ID No. 845) |
| tgcatttttttaaaaaa, | (SEQ ID No. 846) |
| agcttattttttaaat, | (SEQ ID No. 847) |
| aagcttattttttaaat, | (SEQ ID No. 848) |
| taagcttattttttaaat, | (SEQ ID No. 849) |
| tgtaattattagat, | (SEQ ID No. 850) |
| atgtaattattagat, | (SEQ ID No. 851) |
| tgatgtaattatta, | (SEQ ID No. 852) |
| atgatgtaattatta, | (SEQ ID No. 853) |
| atggtattatataa, | (SEQ ID No. 854) |
| tatggtattatataa, | (SEQ ID No. 855) |
| ttatggtattatataa, | (SEQ ID No. 856) |
| tttatggtattatataa, | (SEQ ID No. 857) |
| atttatggtattatataa, | (SEQ ID No. 858) |
| aatcatattagaaa, | (SEQ ID No. 859) |
| ttacaatcatatta, | (SEQ ID No. 860) |
| tttacaatcatatta, | (SEQ ID No. 861) |
| ggcatgacgcctttcc, | (SEQ ID No. 862) |
| gcatgacgcctttc, | (SEQ ID No. 863) |
| gcctgacgagaggc, | (SEQ ID No. 864) |
| ctcaagcctgacgag, | (SEQ ID No. 865) |
| ccacagttcctttttc, | (SEQ ID No. 866) |
| gctgcaataaagatacag, | (SEQ ID No. 867) |
| gctgcaataaagatac, | (SEQ ID No. 868) |
| ggacactgatttctatg, | (SEQ ID No. 869) |
| gcattatcaactttgg, | (SEQ ID No. 870) |
| acttttagcaccaatg, | (SEQ ID No. 871) |
| ccaagaaacttttagcacc, | (SEQ ID No. 872) |
| ccagatcatcttcc, | (SEQ ID No. 873) |
| agtcaaggacacatag, | (SEQ ID No. 874) |
| tctttgagcaacatgg, | (SEQ ID No. 875) |
| gggtataacagctg, | (SEQ ID No. 876) |
| gaggtgaaccattaatgg, | (SEQ ID No. 877) |
| tcttcgtatcgtttag, | (SEQ ID No. 878) |
| tgttggatagtgttc, | (SEQ ID No. 879) |
| gttgatcacttgctg, | (SEQ ID No. 880) |
| ggattccattactcg, | (SEQ ID No. 881) |
| gacatatgaaaaatgttgtc, | (SEQ ID No. 882) |
| gccaataaagacatatg, | (SEQ ID No. 883) |
| ccagaatcaagattctg, | (SEQ ID No. 884) |
| ctgttccagaatcaag, | (SEQ ID No. 885) |
| gacaaatctgttccagaatc, | (SEQ ID No. 886) |
| ggaaagacaaatctgttcc, | (SEQ ID No. 887) |
| gattaagaggacaagc, | (SEQ ID No. 888) |
| ggaagattaagagg, | (SEQ ID No. 889) |
| gcagtgtgattattctgg, | (SEQ ID No. 890) |
| ggagaaagatacatatctg, | (SEQ ID No. 891) |
| ggagatcttacagg, | (SEQ ID No. 892) |
| gcatttgcagtagaatttac, | (SEQ ID No. 893) |
| cagtgaaagagagg, | (SEQ ID No. 894) |
| gctagccgatacac, | (SEQ ID No. 895) |
| ggaagatccttgtatgc, | (SEQ ID No. 896) |
| gcatgaggaagatcc, | (SEQ ID No. 897) |
| ggagtcatttttgttg, | (SEQ ID No. 898) |
| ccaattgatactaagattc, | (SEQ ID No. 899) |
| tcttttgagcacacg, | (SEQ ID No. 900) |

| | |
|---|---|
| ccttcagcacttcttttg, | (SEQ ID No. 901) |
| ggttgcttccttcagc, | (SEQ ID No. 902) |
| cagtggtttaggag, | (SEQ ID No. 903) |
| cctgagatcctcatttc, | (SEQ ID No. 904) |
| ccaaggtcctgagatcc, | (SEQ ID No. 905) |
| ggtgtacacagtgtcc, | (SEQ ID No. 906) |
| tatctttaatttct, | (SEQ ID No. 907) |
| tcttttgaatataa, | (SEQ ID No. 908) |
| ttcttttgaatataa, | (SEQ ID No. 909) |
| tttcttttgaatataa, | (SEQ ID No. 910) |
| ttttcttttgaatataa, | (SEQ ID No. 911) |
| tttttcttttgaatataa, | (SEQ ID No. 912) |
| atttctatgttttt, | (SEQ ID No. 913) |
| ttaaagaatttatg, | (SEQ ID No. 914) |
| gttaaagaatttat, | (SEQ ID No. 915) |
| agttaaagaatttat, | (SEQ ID No. 916) |
| aagttaaagaatttat, | (SEQ ID No. 917) |
| taagttaaagaatttat, | (SEQ ID No. 918) |
| tttagtaagttaaa, | (SEQ ID No. 919) |
| ttttagtaagttaaa, | (SEQ ID No. 920) |
| atttcttttagtaa, | (SEQ ID No. 921) |
| aatttcttttagtaa, | (SEQ ID No. 922) |
| atcaatttctttta, | (SEQ ID No. 923) |
| tatcaatttctttta, | (SEQ ID No. 924) |
| aatatataagttca, | (SEQ ID No. 925) |
| aaatatataagttca, | (SEQ ID No. 926) |
| caaatatataagtt, | (SEQ ID No. 927) |
| tcaaatatataagtt, | (SEQ ID No. 928) |
| tgtcaaatatataa, | (SEQ ID No. 929) |
| aatttatttcagta, | (SEQ ID No. 930) |
| aataaaaatgtgat, | (SEQ ID No. 931) |
| taataaaaatgtgat, | (SEQ ID No. 932) |
| tagctaataaaaat, | (SEQ ID No. 933) |
| ttagctaataaaaat, | (SEQ ID No. 934) |
| tttagctaataaaaat, | (SEQ ID No. 935) |
| aataaaatagtcaa, | (SEQ ID No. 936) |
| taataaaatagtcaa, | (SEQ ID No. 937) |
| ttaataaaatagtcaa, | (SEQ ID No. 938) |
| tttaataaaatagtcaa, | (SEQ ID No. 939) |
| gtttaataaaatagt, | (SEQ ID No. 940) |
| agtttaataaaatagt, | (SEQ ID No. 941) |
| gagtttaataaaata, | (SEQ ID No. 942) |
| agagtttaataaaata, | (SEQ ID No. 943) |
| aataattcttgtat, | (SEQ ID No. 944) |
| tatattacattcat, | (SEQ ID No. 945) |
| atctatattacatt, | (SEQ ID No. 946) |
| ataaacatttttca, | (SEQ ID No. 947) |
| aataaacatttttca, | (SEQ ID No. 948) |
| aaataaacatttttca, | (SEQ ID No. 949) |
| gaaataaacatttttt, | (SEQ ID No. 950) |
| tgaaataaacatttttt, | (SEQ ID No. 951) |
| ttgaaataaacatttttt, | (SEQ ID No. 952) |
| tttgaaataaacatttttt, | (SEQ ID No. 953) |
| ttttgaaataaacatttttt, | (SEQ ID No. 954) |
| tttttgaaataaacatttttt, | (SEQ ID No. 955) |
| attttttgaaataaacatttttt, | (SEQ ID No. 956) |
| aattttttgaaataaacatt, | (SEQ ID No. 957) |
| aaattttttgaaataaacatt, | (SEQ ID No. 958) |
| aaaattttttgaaataaacat, | (SEQ ID No. 959) |
| taaaattttttgaaataaaca, | (SEQ ID No. 960) |
| ataaaattttttgaaataaac, | (SEQ ID No. 961) |
| tataaaattttttgaaataaa, | (SEQ ID No. 962) |
| gtataaaattttttgaaat, | (SEQ ID No. 963) |
| ggtataaaattttttt, | (SEQ ID No. 964) |
| aggtataaaattttttt, | (SEQ ID No. 965) |
| aaggtataaaattttttt, | (SEQ ID No. 966) |
| aaaggtataaaattttttt, | (SEQ ID No. 967) |
| aaaaggtataaaattttttt, | (SEQ ID No. 968) |
| taaaaggtataaaattttttt, | (SEQ ID No. 969) |
| ataaaaggtataaaattttttt, | (SEQ ID No. 970) |
| tttagaaagatttt, | (SEQ ID No. 971) |
| aagataaatttctt, | (SEQ ID No. 972) |
| taagataaatttctt, | (SEQ ID No. 973) |
| ttaagataaatttctt, | (SEQ ID No. 974) |
| tttaagataaatttctt, | (SEQ ID No. 975) |
| ttttaagataaatttctt, | (SEQ ID No. 976) |
| tttttaagataaatttctt, | (SEQ ID No. 977) |
| attttttaagataaatttctt, | (SEQ ID No. 978) |
| tattttttaagataaatttct, | (SEQ ID No. 979) |
| ttattttttaagataaatt, | (SEQ ID No. 980) |
| tttattttttaagataaatt, | (SEQ ID No. 981) |

| | |
|---|---|
| ctttatttttaagataaat, | (SEQ ID No. 982) |
| tctttattttaagataaat, | (SEQ ID No. 983) |
| atctttattttaagataaa, | (SEQ ID No. 984) |
| atctttattttaa, | (SEQ ID No. 985) |
| gatctttattttaa, | (SEQ ID No. 986) |
| agatctttattttaa, | (SEQ ID No. 987) |
| tagatctttattttaa, | (SEQ ID No. 988) |
| aatcatcattaatt, | (SEQ ID No. 989) |
| aaatcatcattaatt, | (SEQ ID No. 990) |
| aaaatcatcattaatt, | (SEQ ID No. 991) |
| taaaatcatcattaatt, | (SEQ ID No. 992) |
| ttaaaatcatcattaatt, | (SEQ ID No. 993) |
| tttaaaatcatcattaatt, | (SEQ ID No. 994) |
| atttaaaatcatcattaatt, | (SEQ ID No. 995) |
| aatttaaaatcatcattaa, | (SEQ ID No. 996) |
| gaatttaaaatcat, | (SEQ ID No. 997) |
| tgaatttaaaatcat, | (SEQ ID No. 998) |
| ttaaaataggaaat, | (SEQ ID No. 999) |
| aatttctctttaaa, | (SEQ ID No. 1000) |
| aaatttctctttaaa, | (SEQ ID No. 1001) |
| taaaattttgaatg, | (SEQ ID No. 1002) |
| ctaaaattttgaat, | (SEQ ID No. 1003) |
| tttgctaaaatttt, | (SEQ ID No. 1004) |
| atatgaaaaatgtt, | (SEQ ID No. 1005) |
| ttttaaattaagca, | (SEQ ID No. 1006) |
| ttgtaaaaatcaaa, | (SEQ ID No. 1007) |
| tttgtaaaaatcaaa, | (SEQ ID No. 1008) |
| tttgataaaacttt, | (SEQ ID No. 1009) |
| atgttttatcattt, | (SEQ ID No. 1010) |
| aatgttttatcattt, | (SEQ ID No. 1011) |
| aaatgttttatcattt, | (SEQ ID No. 1012) |
| taaatgttttatcattt, | (SEQ ID No. 1013) |
| tctaaatgtttat, | (SEQ ID No. 1014) |
| ttctaaatgttttat, | (SEQ ID No. 1015) |
| taagatcaaataaa, | (SEQ ID No. 1016) |
| ataagatcaaataaa, | (SEQ ID No. 1017) |
| aataagatcaaataaa, | (SEQ ID No. 1018) |
| taataagatcaaataaa, | (SEQ ID No. 1019) |
| ttaataagatcaaataaa, | (SEQ ID No. 1020) |
| tttaataagatcaaataaa, | (SEQ ID No. 1021) |
| ttgtttaataagat, | (SEQ ID No. 1022) |
| attgtttaataagat, | (SEQ ID No. 1023) |
| tgattgtttaataa, | (SEQ ID No. 1024) |
| ttgattgtttaataa, | (SEQ ID No. 1025) |
| tttgattgtttaataa, | (SEQ ID No. 1026) |
| ttttataaaacagt, | (SEQ ID No. 1027) |
| tttttataaaacagt, | (SEQ ID No. 1028) |
| ttttttataaaacagt, | (SEQ ID No. 1029) |
| cttttttataaaaca, | (SEQ ID No. 1030) |
| acttttttataaaaca, | (SEQ ID No. 1031) |
| cactttttataaaa, | (SEQ ID No. 1032) |
| acactttttataaaa, | (SEQ ID No. 1033) |
| tacactttttataaaa, | (SEQ ID No. 1034) |
| atacactttttataaaa, | (SEQ ID No. 1035) |
| attttgaatttaag, | (SEQ ID No. 1036) |
| gattttgaatttaa, | (SEQ ID No. 1037) |
| tgattttgaatttaa, | (SEQ ID No. 1038) |
| atgattttgaatttaa, | (SEQ ID No. 1039) |
| aatgattttgaatttaa, | (SEQ ID No. 1040) |
| ataatagaatcata, | (SEQ ID No. 1041) |
| tataatagaatcata, | (SEQ ID No. 1042) |
| tataatagaatcat, | (SEQ ID No. 1043) |
| tactataatagaat, | (SEQ ID No. 1044) |
| atactataatagaat, | (SEQ ID No. 1045) |
| aatactataatagaat, | (SEQ ID No. 1046) |
| agaatactataata, | (SEQ ID No. 1047) |
| tagaatactataata, | (SEQ ID No. 1048) |
| atagaatactataata, | (SEQ ID No. 1049) |
| tatagaatactataata, | (SEQ ID No. 1050) |
| ttatagaatactataata, | (SEQ ID No. 1051) |
| aatatttgttttca, | (SEQ ID No. 1052) |
| aaatatttgttttca, | (SEQ ID No. 1053) |
| aaaatatttgttttca, | (SEQ ID No. 1054) |
| caaaatatttgtttt, | (SEQ ID No. 1055) |
| aaatttatatgga, | (SEQ ID No. 1056) |
| tgaaattttatatg, | (SEQ ID No. 1057) |
| ctgaaattttatat, | (SEQ ID No. 1058) |
| tctgaaattttatat, | (SEQ ID No. 1059) |
| ttctgaaattttatat, | (SEQ ID No. 1060) |
| atctgatttattt, | (SEQ ID No. 1061) |
| aagatattaaatgt, | (SEQ ID No. 1062) |

-continued

| | |
|---|---|
| tgaagatattaaat, | (SEQ ID No. 1063) |
| ataaataacaatga, | (SEQ ID No. 1064) |
| tataaataacaatga, | (SEQ ID No. 1065) |
| gtataaataacaat, | (SEQ ID No. 1066) |
| tgtataaataacaat, | (SEQ ID No. 1067) |
| ttgtataaataacaat, | (SEQ ID No. 1068) |
| tcttgtataaataa, | (SEQ ID No. 1069) |
| atcttgtataaataa, | (SEQ ID No. 1070) |
| aatcttgtataaataa, | (SEQ ID No. 1071) |
| acaactttttaaat, | (SEQ ID No. 1072) |
| tacaactttttaaat, | (SEQ ID No. 1073) |
| tacaactttttaaa, | (SEQ ID No. 1074) |
| cgggggtttttgggcggcatg, | (SEQ ID No. 1075) |
| ttttcggggggttttgggcggca, | (SEQ ID No. 1076) |
| tcggggggttttgggcggc, | (SEQ ID No. 1077) |
| ggtggcggccgttttctcggggggt, | (SEQ ID No. 1078) |
| ccgggggttccgcggcggcagcg, | (SEQ ID No. 1079) |
| cgggggttccgcggcgg, | (SEQ ID No. 1080) |
| ggcggcggtgccggggttccgc, | (SEQ ID No. 1081) |
| ggaggggcggcggcggcggtg, | (SEQ ID No. 1082) |
| gggggcgcggcggcgg, | (SEQ ID No. 1083) |
| ggggcggcggcggcg, | (SEQ ID No. 1084) |
| aggggggcctggtggaag, | (SEQ ID No. 1085) |
| taggggggcctggtg, | (SEQ ID No. 1086) |
| gtaggggggcctggt, | (SEQ ID No. 1087) |
| gaggtattggtgacaaggtagggggc, | (SEQ ID No. 1088) |
| tcttcagggggtgaaatatagatgttc, | (SEQ ID No. 1089) |
| ggactcttcaggggtg, | (SEQ ID No. 1090) |
| tcggactatactgc, | (SEQ ID No. 1091) |
| cagttcggactatact, | (SEQ ID No. 1092) |
| aagcctaagacgca, | (SEQ ID No. 1093) |
| gcccaagttcaaca, | (SEQ ID No. 1094) |
| tgaaagtcgcggt, | (SEQ ID No. 1095) |
| ggttaattaagatgcctc, | (SEQ ID No. 1096) |
| tctctaagagcgca, | (SEQ ID No. 1097) |
| acgtgaggttagtttg, | (SEQ ID No. 1098) |
| cacgtgaggttagt, | (SEQ ID No. 1099) |
| catagaacagtccg, | (SEQ ID No. 1100) |
| cagtcatagaacagtc, | (SEQ ID No. 1101) |
| ctttgcagtcatagaaca, | (SEQ ID No. 1102) |
| tgcagtcatagaac, | (SEQ ID No. 1103) |
| ggtcgtttccatct, | (SEQ ID No. 1104) |
| catagaaggtcgtttc, | (SEQ ID No. 1105) |
| cgtcatagaaggtc, | (SEQ ID No. 1106) |
| catcgtcatagaagg, | (SEQ ID No. 1107) |
| ggacgggaggaacgaggcgttgag, | (SEQ ID No. 1108) |
| tagccataaggtcc, | (SEQ ID No. 1109) |
| ggttactgtagcca, | (SEQ ID No. 1110) |
| ggttactgtagcca, | (SEQ ID No. 1111) |
| agttcttggcgcggaggt, | (SEQ ID No. 1112) |
| aggtgaggaggtccgagt, | (SEQ ID No. 1113) |
| tggactggattatcag, | (SEQ ID No. 1114) |
| gtggtggtgatgtgcccg, | (SEQ ID No. 1115) |
| tgtcacgttcttgg, | (SEQ ID No. 1116) |
| ctcatctgtcacgt, | (SEQ ID No. 1117) |
| cgaagccctcggcgaacc, | (SEQ ID No. 1118) |
| gcgtgttctggctgtgcagttcgg, | (SEQ ID No. 1119) |
| ctgccccgttgacc, | (SEQ ID No. 1120) |
| aggtttgcgtagac, | (SEQ ID No. 1121) |
| ggttgaagttgctg, | (SEQ ID No. 1122) |
| ctgggttgaagttg, | (SEQ ID No. 1123) |
| tgctgcacgggcatctgctg, | (SEQ ID No. 1124) |
| ggcactgtctgaggctcctccttcagg, | (SEQ ID No. 1125) |
| actccatgtcgatg, | (SEQ ID No. 1126) |
| ctctccgccttgatcc, | (SEQ ID No. 1127) |
| gttcctcatgcgcttc, | (SEQ ID No. 1128) |
| ctgagctttcaagg, | (SEQ ID No. 1129) |
| gcgattctctccagcttccttttttcg, | (SEQ ID No. 1130) |
| ctgagctttcaaggttttcacttttttcctc, | (SEQ ID No. 1131) |
| tccctgagcatgtt, | (SEQ ID No. 1132) |
| tctgtttaagctgtgc, | (SEQ ID No. 1133) |
| ctttctgtttaagctgtg, | (SEQ ID No. 1134) |
| ggttcatgactttctg, | (SEQ ID No. 1135) |
| cgtggttcatgact, | (SEQ ID No. 1136) |
| actgttaacgtggttc, | (SEQ ID No. 1137) |
| ccactgttaacgtg, | (SEQ ID No. 1138) |
| cccactgttaacgt, | (SEQ ID No. 1139) |
| agcatgagttggca, | (SEQ ID No. 1140) |
| gcgttagcatgagt, | (SEQ ID No. 1141) |
| gtttgcaactgctg, | (SEQ ID No. 1142) |
| caaaatgtttgcaactgc, | (SEQ ID No. 1143) |

-continued

| | |
|---|---|
| tccattttagtgcacatc, | (SEQ ID No. 1144) |
| ctgttccattttagtgca, | (SEQ ID No. 1145) |
| gtgtatgagtcgtc, | (SEQ ID No. 1146) |
| ctgtgtatgagtcg, | (SEQ ID No. 1147) |
| cgtagctgtgtatg, | (SEQ ID No. 1148) |
| tcgtgtagagagag, | (SEQ ID No. 1149) |
| agtttgtagtcgtgtaga, | (SEQ ID No. 1150) |
| gtttgtagtcgtgtag, | (SEQ ID No. 1151) |
| agtttgtagtcgtg, | (SEQ ID No. 1152) |
| ggagtttgtagtcg, | (SEQ ID No. 1153) |
| tcaggagtttgtagtc, | (SEQ ID No. 1154) |
| gtttcaggagtttgtagt, | (SEQ ID No. 1155) |
| tcggtttcaggagt, | (SEQ ID No. 1156) |
| ttgagactccggta, | (SEQ ID No. 1157) |
| accagaaaagtagctg, | (SEQ ID No. 1158) |
| cctgaccagaaaag, | (SEQ ID No. 1159) |
| attcaggcgttcca, | (SEQ ID No. 1160) |
| ggtaaaagtactgtcc, | (SEQ ID No. 1161) |
| gggtaaaagtactgtc, | (SEQ ID No. 1162) |
| gcacctccaccgctgcca, | (SEQ ID No. 1163) |
| ctcctgctcctcggtgac, | (SEQ ID No. 1164) |
| gctttgacaaagcc, | (SEQ ID No. 1165) |
| cttgtgcagatcgt, | (SEQ ID No. 1166) |
| tcatcttgtgcagatc, | (SEQ ID No. 1167) |
| gttcatcttgtgcaga, | (SEQ ID No. 1168) |
| cgtggttcatcttg, | (SEQ ID No. 1169) |
| tcacgtggttcatc, | (SEQ ID No. 1170) |
| ggttggtgtaaacg, | (SEQ ID No. 1171) |
| tacgagctcccggtcccgac, | (SEQ ID No. 1172) |
| tagctgatggtggt, | (SEQ ID No. 1173) |
| tccttgaaggtgga, | (SEQ ID No. 1174) |
| tcttccatgttgatgg, | (SEQ ID No. 1175) |
| ctttgatgcgctct, | (SEQ ID No. 1176) |
| ctccactttgatgc, | (SEQ ID No. 1177) |
| gctccagcttccgcttccggcacttggtgg, | (SEQ ID No. 1178) |
| ggccttgagcgtcttcaccttgtcctccag, | (SEQ ID No. 1179) |
| tgaccttctgtttgag, | (SEQ ID No. 1180) |
| catgaccttctgtttg, | (SEQ ID No. 1181) |
| gtcatgaccttctg, | (SEQ ID No. 1182) |
| cgagaacatcatcg, | (SEQ ID No. 1183) |
| gtagtctgcgttga, | (SEQ ID No. 1184) |
| gctgcagcgggaggatgacg, | (SEQ ID No. 1185) |
| agtaagagaggctatc, | (SEQ ID No. 1186) |
| gtagtaagagaggc, | (SEQ ID No. 1187) |
| ggtagtaagagagg, | (SEQ ID No. 1188) |
| gtgagtggtagtaaga, | (SEQ ID No. 1189) |
| gtccgtgcagaagtcctg, | (SEQ ID No. 1190) |
| gaatgaagttggcact, | (SEQ ID No. 1191) |
| ggaatgaagttggc, | (SEQ ID No. 1192) |
| gggaatgaagttgg, | (SEQ ID No. 1193) |
| gctgcaccagccactgcaggtccggactgg, | (SEQ ID No. 1194) |
| tcatggtcttcacaac, | (SEQ ID No. 1195) |
| caatgctctgcgctcggcctcctgtcatgg, | (SEQ ID No. 1196) |
| ctagagttcctcac, | (SEQ ID No. 1197) |
| gagtacgctagagt, | (SEQ ID No. 1198) |
| gaagagtacgctag, | (SEQ ID No. 1199) |
| ctgcttcccacccagcccccacattccc, | (SEQ ID No. 1200) |
| ttcatcctctgtactgggct, | (SEQ ID No. 1201) |
| gttacggatgtgca, | (SEQ ID No. 1202) |
| cagttacggatgtg, | (SEQ ID No. 1203) |
| ccagttacggatgt, | (SEQ ID No. 1204) |
| agagtctgagttgg, | (SEQ ID No. 1205) |
| gtgagactcagagt, | (SEQ ID No. 1206) |
| tcttagggtgagac, | (SEQ ID No. 1207) |
| gagagtacttcttagg, | (SEQ ID No. 1208) |
| ggaagaaactatgagagt, | (SEQ ID No. 1209) |
| cttagggaagaaactatg, | (SEQ ID No. 1210) |
| cggtaagaaacttagg, | (SEQ ID No. 1211) |
| agcatgcgtaaga, | (SEQ ID No. 1212) |
| gtctgaaagcatgc, | (SEQ ID No. 1213) |
| agaacaaagaagagcc, | (SEQ ID No. 1214) |
| caagagaacaaagaagag, | (SEQ ID No. 1215) |
| cagcaagagaacaaag, | (SEQ ID No. 1216) |
| tcctcagcaagaga, | (SEQ ID No. 1217) |
| aggtgtgacttgca, | (SEQ ID No. 1218) |
| gaataggtgtgacttg, | (SEQ ID No. 1219) |
| cagaataggtgtgact, | (SEQ ID No. 1220) |
| gcagaataggtgtg, | (SEQ ID No. 1221) |
| cagttgcagaatagg, | (SEQ ID No. 1222) |
| gaaaccatttctgacc, | (SEQ ID No. 1223) |
| tgtgaaaccatttctgac, | (SEQ ID No. 1224) |

| | | | |
|---|---|---|---|
| cactgtgaaaccatttct, | (SEQ ID No. 1225) | gtagtaggaaaggc, | (SEQ ID No. 1265) |
| ccactgtgaaacca, | (SEQ ID No. 1226) | ggtagtaggaaagg, | (SEQ ID No. 1266) |
| agaactggctcctgcagcttccctgcttcc, | (SEQ ID No. 1227) | ggaatggtagtagg, | (SEQ ID No. 1267) |
| cacctccattcaccc, | (SEQ ID No. 1228) | ggtcattgagaagag, | (SEQ ID No. 1268) |
| cagtaaaagtgtctgc, | (SEQ ID No. 1229) | gctaatgttcttgacc, | (SEQ ID No. 1269) |
| cgacattcagtaaaagtg, | (SEQ ID No. 1230) | gccaaggtcctcat, | (SEQ ID No. 1270) |
| gaccgacattcagt, | (SEQ ID No. 1231) | ggagtctatctcca, | (SEQ ID No. 1271) |
| cttctggagataactaga, | (SEQ ID No. 1232) | ccaaagaatcctgact, | (SEQ ID No. 1272) |
| catcttattcctttccct, | (SEQ ID No. 1233) | cacatgcttagtgg, | (SEQ ID No. 1273) |
| cagccatcttattcct, | (SEQ ID No. 1234) | ctcgtaaatgaccg, | (SEQ ID No. 1274) |
| tgcagccatcttattc, | (SEQ ID No. 1235) | aggaatctcgtaaatgac, | (SEQ ID No. 1275) |
| gagtgtatcagtcag, | (SEQ ID No. 1236) | cagcagcgattcat, | (SEQ ID No. 1276) |
| ggagtgtatcagtc, | (SEQ ID No. 1237) | ggagatcatcaaagga, | (SEQ ID No. 1277) |
| cttggagtgtatcagt, | (SEQ ID No. 1238) | ctcagcaatggtca, | (SEQ ID No. 1278) |
| acagagtacctacc, | (SEQ ID No. 1239) | gatctcgaacacct, | (SEQ ID No. 1279) |
| ccaactttcccttaag, | (SEQ ID No. 1240) | cacaatctcgatctttct, | (SEQ ID No. 1280) |
| ccttatgctcaatctc, | (SEQ ID No. 1241) | ccttcttaaagattggct, | (SEQ ID No. 1281) |
| gtcttactcaaggg, | (SEQ ID No. 1242) | cacataccaactgg, | (SEQ ID No. 1282) |
| acagtcttactcaagg, | (SEQ ID No. 1243) | agcttgatgtgagg, | (SEQ ID No. 1283) |
| cataagacacagtcttac, | (SEQ ID No. 1244) | gaagttgtagcttgatgt, | (SEQ ID No. 1284) |
| gaaagcataagacacagt, | (SEQ ID No. 1245) | gcttgaagttgtagct, | (SEQ ID No. 1285) |
| ggaaagcataagacac, | (SEQ ID No. 1246) | ctgcttgaagttgtag, | (SEQ ID No. 1286) |
| agggataaaggaaagc, | (SEQ ID No. 1247) | gacacaactcctct, | (SEQ ID No. 1287) |
| cctgtatacagagg, | (SEQ ID No. 1248) | tcctttgatagacacaac, | (SEQ ID No. 1288) |
| tgtctcctgtatacag, | (SEQ ID No. 1249) | ctcgtttgatagacac, | (SEQ ID No. 1289) |
| catcttctagttggtc, | (SEQ ID No. 1250) | ggttagcacacact, | (SEQ ID No. 1290) |
| ctcatcttctagttgg, | (SEQ ID No. 1251) | ggtaacggttagca, | (SEQ ID No. 1291) |
| cttctcatcttctagttg, | (SEQ ID No. 1252) | cgtaacacatttagaagc, | (SEQ ID No. 1292) |
| caaagcagacttctca, | (SEQ ID No. 1253) | ctcatccgtaacac, | (SEQ ID No. 1293) |
| ctgcaaagcagact, | (SEQ ID No. 1254) | ccggtaagtattgtagtt, | (SEQ ID No. 1294) |
| ctagttttccttctcct, | (SEQ ID No. 1255) | ggtgtatttccttgac, | (SEQ ID No. 1295) |
| tctagttttccttctcc, | (SEQ ID No. 1256) | acataccaactggtgt, | (SEQ ID No. 1296) |
| caggatgaactctagt, | (SEQ ID No. 1257) | gtccctatacgaac, | (SEQ ID No. 1297) |
| tcgtagaaggtcgt, | (SEQ ID No. 1258) | ttcatgtctgtgcc, | (SEQ ID No. 1298) |
| agggttactgtagc, | (SEQ ID No. 1259) | gtaggtgagttcca, | (SEQ ID No. 1299) |
| gtagtggtgatgtg, | (SEQ ID No. 1260) | gttgtgagcgatga, | (SEQ ID No. 1300) |
| cgtcgtagaaggtc, | (SEQ ID No. 1261) | catagttgtcctcaaaga, | (SEQ ID No. 1301) |
| tttcgtgcacatcc, | (SEQ ID No. 1262) | ggcatagttgtcct, | (SEQ ID No. 1302) |
| agtttgtagtcgtgaaga, | (SEQ ID No. 1263) | cattgtctagcacg, | (SEQ ID No. 1303) |
| cgagaacatcatgg, | (SEQ ID No. 1264) | ctccattgtctagc, | (SEQ ID No. 1304) |
| | | gtattgttcagcgg, | (SEQ ID No. 1305) | tcaagatctctgtgag, (SEQ ID No. 1306)
cacaaaatcgtgtcct, (SEQ ID No. 1307)
tccttccacaaaatcg, (SEQ ID No. 1308)
gtggaagatgtcct, (SEQ ID No. 1309)
tcttgtggaagatgtc, (SEQ ID No. 1310)
tctatcagtgtgagag, (SEQ ID No. 1311)
ggttggtgtctatc, (SEQ ID No. 1312)
acatcggagaacag, (SEQ ID No. 1313)
ccttacacatcgga, (SEQ ID No. 1314)
acaatcctcagaactc, (SEQ ID No. 1315)
gctctgacaatcct, (SEQ ID No. 1316)
tggttgaagtggag, (SEQ ID No. 1317)
ctgtggttgaagtg, (SEQ ID No. 1318)
gttgtaggtgacca, (SEQ ID No. 1319)
ctgtgttgtaggtg, (SEQ ID No. 1320)
gactcaaacgtgtc, (SEQ ID No. 1321)
catggactcaaacg, (SEQ ID No. 1322)
cgaatgtataccgg, (SEQ ID No. 1323)
ccgaatgtataccg, (SEQ ID No. 1324)
gccgaatgtatacc, (SEQ ID No. 1325)
gtagttgtagggac, (SEQ ID No. 1326)
tagaaaggtagttgtagg, (SEQ ID No. 1327)
gtagaaaggtagttgtag, (SEQ ID No. 1328)
cgtagaaaggtagtttg, (SEQ ID No. 1329)
ccgtagaaaggtag, (SEQ ID No. 1330)
gaccatagcacact, (SEQ ID No. 1331)
ggatattggcactg, (SEQ ID No. 1332)
cctggatattggca, (SEQ ID No. 1333)
gctcccaaagatct, (SEQ ID No. 1334)
cccatcaaagctct, (SEQ ID No. 1335)
caaacacttggagc, (SEQ ID No. 1336)
gtctcaaacacttgga, (SEQ ID No. 1337)
gagtctcaaacacttg, (SEQ ID No. 1338)
gtaacctgtgatctct, (SEQ ID No. 1339)
ggtaacctgtgatc, (SEQ ID No. 1340)
gtataggtaacctgtg, (SEQ ID No. 1341)
tgagatgtataggtaacc, (SEQ ID No. 1342)
tgctgagatgtatagg, (SEQ ID No. 1343)
ccatgctgagatgt, (SEQ ID No. 1344)
ggattacttgcagg, (SEQ ID No. 1345)
tgttatggtggatgag, (SEQ ID No. 1346)
ggtgttatggtgga, (SEQ ID No. 1347)
gcagttgacacact, (SEQ ID No. 1348)
agtactcggcattc, (SEQ ID No. 1349)
cattcacatactccct, (SEQ ID No. 1350)
tccaaaacaggtcact, (SEQ ID No. 1351)
ggtccttatagtgg, (SEQ ID No. 1352)
cagaatgccaacca, (SEQ ID No. 1353)
acgagaatgccaac, (SEQ ID No. 1354)
gatcccaaagacca, (SEQ ID No. 1355)
tcgcttgatgagga, (SEQ ID No. 1356)
catcgtgtacttcc, (SEQ ID No. 1357)
gcatcgtgtacttc, (SEQ ID No. 1358)
actgtgccaaaagc, (SEQ ID No. 1359)
cttgtagactgtgc, (SEQ ID No. 1360)
cccttgtagactgt, (SEQ ID No. 1361)
tcaacactttgatggc, (SEQ ID No. 1362)
ccctcaacactttg, (SEQ ID No. 1363)
gtgttttccctcaaca, (SEQ ID No. 1364)
gtatgcttcgtctaag, (SEQ ID No. 1365)
cgtatgcttcgtct, (SEQ ID No. 1366)
ccatcacgtatgct, (SEQ ID No. 1367)
gcataagctgtgtc, (SEQ ID No. 1368)
catggtctaagagg, (SEQ ID No. 1369)
caatctgcatacacca, (SEQ ID No. 1370)
ggcaatctgcatac, (SEQ ID No. 1371)
ctgtctcgtcaatg, (SEQ ID No. 1372)
cataactccacacatc, (SEQ ID No. 1373)
agtcacaccataactc, (SEQ ID No. 1374)
acagtcacaccataac, (SEQ ID No. 1375)
ccccaaaagtcatc, (SEQ ID No. 1376)
tcgtaaggtttggc, (SEQ ID No. 1377)
gatcccatcgtaag, (SEQ ID No. 1378)
caatggtgcagatg, (SEQ ID No. 1379)
gacatcaatggtgc, (SEQ ID No. 1380)
gtagacatcaatggtg, (SEQ ID No. 1381)
catgatcatgtagacatc, (SEQ ID No. 1382)
ccatgatcatgtagac, (SEQ ID No. 1383)
catttgaccatgatcatg, (SEQ ID No. 1384)
ccaacatttgaccatg, (SEQ ID No. 1385)
tcatccaacatttgacca, (SEQ ID No. 1386)

| | |
|---|---|
| gagtcaatcatccaacat, | (SEQ ID No. 1387) |
| cagagtcaatcatcca, | (SEQ ID No. 1388) |
| ccgacattcagagt, | (SEQ ID No. 1389) |
| gaattcagacaccaac, | (SEQ ID No. 1390) |
| gatgaccacaaagc, | (SEQ ID No. 1391) |
| ccatcaaatacatcgg, | (SEQ ID No. 1392) |
| tcaccatcaaatacatcg, | (SEQ ID No. 1393) |
| caacgtagccatca, | (SEQ ID No. 1394) |
| acgtctttgacgac, | (SEQ ID No. 1395) |
| caaaaacgtctttgacga, | (SEQ ID No. 1396) |
| ggcaaaaacgtctttg, | (SEQ ID No. 1397) |
| caaaggcaaaaacgtc, | (SEQ ID No. 1398) |
| gtgtcaagtactcg, | (SEQ ID No. 1399) |
| gtaatagaggttgtcg, | (SEQ ID No. 1400) |
| cccagtaatagagg, | (SEQ ID No. 1401) |
| catggtgctcactg, | (SEQ ID No. 1402) |
| gtgcctgtacgtac, | (SEQ ID No. 1403) |
| tgcaggtggatagt, | (SEQ ID No. 1404) |
| catgtcgatagtcttgca, | (SEQ ID No. 1405) |
| gtcgatagtcttgc, | (SEQ ID No. 1406) |
| ccatgtcgatagtc, | (SEQ ID No. 1407) |
| ctccatgtcgatag, | (SEQ ID No. 1408) |
| cttggacaggatct, | (SEQ ID No. 1409) |
| tgctgttgtacagg, | (SEQ ID No. 1410) |
| gtgctgttgtacag, | (SEQ ID No. 1411) |
| ttggcgtagtagtc, | (SEQ ID No. 1412) |
| tccaccattagcac, | (SEQ ID No. 1413) |
| gatttcgttgtggg, | (SEQ ID No. 1414) |
| gtcatagatttcgttgtg, | (SEQ ID No. 1415) |
| tgtactctgcttgaac, | (SEQ ID No. 1416) |
| gtgtactctgcttg, | (SEQ ID No. 1417) |
| tgctgtgtgtactc, | (SEQ ID No. 1418) |
| ctgatgtgttgaagaaca, | (SEQ ID No. 1419) |
| ctctgatgtgttgaag, | (SEQ ID No. 1420) |
| gctctgatgtgttg, | (SEQ ID No. 1421) |
| gagctctgatgtgt, | (SEQ ID No. 1422) |
| cacttttaacttgagcct, | (SEQ ID No. 1423) |
| ctccacttttaacttgag, | (SEQ ID No. 1424) |
| tgctgtatttctggtaca, | (SEQ ID No. 1425) |
| ccaggaattgttgc, | (SEQ ID No. 1426) |
| ttgctgaggtatcg, | (SEQ ID No. 1427) |
| gataaccactctgg, | (SEQ ID No. 1428) |
| caaaagataaccactctg, | (SEQ ID No. 1429) |
| cggtgacatcaaaag, | (SEQ ID No. 1430) |
| cctcaatttcccct, | (SEQ ID No. 1431) |
| gttatccctgctgt, | (SEQ ID No. 1432) |
| gcagtgtgttatcc, | (SEQ ID No. 1433) |
| gatgtccacttgca, | (SEQ ID No. 1434) |
| tagtgaaccgttg, | (SEQ ID No. 1435) |
| tgccatgaatggtg, | (SEQ ID No. 1436) |
| gttcatgccatgaatg, | (SEQ ID No. 1437) |
| catgagaagcagga, | (SEQ ID No. 1438) |
| gctttgcagatgct, | (SEQ ID No. 1439) |
| gagctttgcagatg, | (SEQ ID No. 1440) |
| tagttggtgtccag, | (SEQ ID No. 1441) |
| ctgaagcaatagttgg, | (SEQ ID No. 1442) |
| agctgaagcaatagttgg, | (SEQ ID No. 1443) |
| ggagctgaagcaat, | (SEQ ID No. 1444) |
| caatgtacagctgc, | (SEQ ID No. 1445) |
| ggaagtcaatgtacag, | (SEQ ID No. 1446) |
| cggaagtcaatgtac, | (SEQ ID No. 1447) |
| gcggaagtcaatgt, | (SEQ ID No. 1448) |
| agttggcatggtag, | (SEQ ID No. 1449) |
| gcagaagttggcat, | (SEQ ID No. 1450) |
| ctccaaatgtaggg, | (SEQ ID No. 1451) |
| accttgctgtactg, | (SEQ ID No. 1452) |
| tgctggttgtacag, | (SEQ ID No. 1453) |
| ggttatgctggttg, | (SEQ ID No. 1454) |
| gtagtacgatgg, | (SEQ ID No. 1455) |
| cgtagtacacgatg, | (SEQ ID No. 1456) |
| cacgtagtacacga, | (SEQ ID No. 1457) |
| catgttggacagct, | (SEQ ID No. 1458) |
| gcacgatcatgttg, | (SEQ ID No. 1459) |
| cacacagtagtgca, | (SEQ ID No. 1460) |
| gatcagaaaagcgc, | (SEQ ID No. 1461) |
| accgtgaccagatg, | (SEQ ID No. 1462) |
| gtagacaggctgag, | (SEQ ID No. 1463) |
| tatcgagtgtgctg, | (SEQ ID No. 1464) |
| ttgcgcatgaactg, | (SEQ ID No. 1465) |
| ttgctcaggatctg, | (SEQ ID No. 1466) |
| actggtgagcttca, | (SEQ ID No. 1467) |

-continued gctcaggatagtct, (SEQ ID No. 1468)

tgtagatggaaatcacct, (SEQ ID No. 1469)

tggtgctgttgtag, (SEQ ID No. 1470)

ttctcctggagcaa, (SEQ ID No. 1471)

tactcttcgtcgct, (SEQ ID No. 1472)

cttggcgtagtact, (SEQ ID No. 1473)

cggcatgtctattttgta, (SEQ ID No. 1474)

cgggatggcatttt, (SEQ ID No. 1475)

ctgtagaaagtggg, (SEQ ID No. 1476)

acaattctgaagtagggt, (SEQ ID No. 1477)

attgctgagacgtcaaat, (SEQ ID No. 1478)

tctccattgctgag, (SEQ ID No. 1479)

tcaccaaattggaagcat, (SEQ ID No. 1480)

ctctgaactctgct, (SEQ ID No. 1481)

aacgaaagactctgaact, (SEQ ID No. 1482)

tgggttctgcaaac, (SEQ ID No. 1483)

ctggcttttgggtt, (SEQ ID No. 1484)

gttgttcaggcact, (SEQ ID No. 1485)

tctgatatagctcaatcc, (SEQ ID No. 1486)

tctttggacttgagaatc, (SEQ ID No. 1487)

tgggttggagatgt, (SEQ ID No. 1488)

tgctgtcgatgtag, (SEQ ID No. 1489)

acaactttgctgtcga, (SEQ ID No. 1490)

attcgccttctgct, (SEQ ID No. 1491)

gaaggagagccatt, (SEQ ID No. 1492)

tcagttacatcgaagg, (SEQ ID No. 1493)

tgaagccattcatgaaca, (SEQ ID No. 1494)

tcctgtctttatggtg, (SEQ ID No. 1495)

aaatcccaggttcc, (SEQ ID No. 1496)

ggacagtgtaagcttatt, (SEQ ID No. 1497)

gtacaaaagtgcagca, (SEQ ID No. 1498)

tagatggtacaaaagtgc, (SEQ ID No. 1499)

cacttttatttgggatgatg, (SEQ ID No. 1500)

gcaaatcttgcttctagt, (SEQ ID No. 1501)

gtgccatcaatacc, (SEQ ID No. 1502)

ggtatatgtggagg, (SEQ ID No. 1503)

tctgatcaccactg, (SEQ ID No. 1504)

tcctagtggactttatag, (SEQ ID No. 1505)

tttttcctagtggact, (SEQ ID No. 1506)

caataacattagcagg, (SEQ ID No. 1507)

aagtctgtaggagg, (SEQ ID No. 1508)

tctgttgtgactcaag, (SEQ ID No. 1509)

gttggtctgttgtg, (SEQ ID No. 1510)

caaagcacgcttct, (SEQ ID No. 1511)

tttctaaagcaataggcc, (SEQ ID No. 1512)

gcaattatcctgcaca, (SEQ ID No. 1513)

acgtaggcagcaat, (SEQ ID No. 1514)

atcaatgtaaagtggacg, (SEQ ID No. 1515)

ctagatccctcttg, (SEQ ID No. 1516)

ccatttccaccta, (SEQ ID No. 1517)

tgggttcgtgtatc, (SEQ ID No. 1518)

tggcattgtaccct, (SEQ ID No. 1519)

tccagcacagaagt, (SEQ ID No. 1520)

ataaatacgggcatgc, (SEQ ID No. 1521)

agtgtctgaactcc, (SEQ ID No. 1522)

tgtgctgagtgtct, (SEQ ID No. 1523)

ataagctcaggacc, (SEQ ID No. 1524)

aggagaagcagatg, (SEQ ID No. 1525)

agcaaggagaagca, (SEQ ID No. 1526)

aatcttgggacacg, (SEQ ID No. 1527)

tagagaatggttagaggt, (SEQ ID No. 1528)

gttttgccaatgtagtag, (SEQ ID No. 1529)

cttgggtgttttgc, (SEQ ID No. 1530)

gcaagactttacaatc, (SEQ ID No. 1531)

gcatttgcaagactttac, (SEQ ID No. 1532)

tttagctgcatttgcaag, (SEQ ID No. 1533)

gccacttttccaag, (SEQ ID No. 1534)

ttggtcttgccact, (SEQ ID No. 1535)

cagcacacagtagt, (SEQ ID No. 1536)

cgatagtcttgcag, (SEQ ID No. 1537)

ctttcaccaaattggaag, (SEQ ID No. 1538)

caccaaattggaagc, (SEQ ID No. 1539)

tcaccaaattggaagc, (SEQ ID No. 1540)

ctctggcttttggg, (SEQ ID No. 1541)

cggcatgtctattttg, (SEQ ID No. 1542)

cactacagacgagc, (SEQ ID No. 1543)

cgtgcactacagacg, (SEQ ID No. 1544)

ggaacagttcgtcc, (SEQ ID No. 1545)

gaacagttcgtccatg, (SEQ ID No. 1546)

ccagagtttcggttc, (SEQ ID No. 1547)

ctaggactgggacag, (SEQ ID No. 1548)

-continued

| | |
|---|---|
| cgcacttgtagcg, | (SEQ ID No. 1549) |
| ctcgcacttgtagc, | (SEQ ID No. 1550) |
| gcacttgtagc, | (SEQ ID No. 1551) |
| gcgcactgtccctg, | (SEQ ID No. 1552) |
| ccagggagatgcgc, | (SEQ ID No. 1553) |
| gccggtgaggagg, | (SEQ ID No. 1554) |
| ccggtgaggaggg, | (SEQ ID No. 1555) |
| cggttcactcggc, | (SEQ ID No. 1556) |
| gagtttcggttcactc, | (SEQ ID No. 1557) |
| ggcacgattgtcaaag, | (SEQ ID No. 1558) |
| caggcgtcacccc, | (SEQ ID No. 1559) |
| gcaggcgtcaccc, | (SEQ ID No. 1560) |
| ctccctcctaagc, | (SEQ ID No. 1561) |
| ccctcctaagcgg, | (SEQ ID No. 1562) |
| cgagtccgcgttcg, | (SEQ ID No. 1563) |
| catcttctgccattc, | (SEQ ID No. 1564) |
| gtgttttcccaccag, | (SEQ ID No. 1565) |
| ggttttggttcactag, | (SEQ ID No. 1566) |
| gcatcttcacgtctcc, | (SEQ ID No. 1567) |
| cttcacgtctcctgtc, | (SEQ ID No. 1568) |
| gtcaccgcgtagtc, | (SEQ ID No. 1569) |
| caaataggcaaggtc, | (SEQ ID No. 1570) |
| cttgcaaataggcaag, | (SEQ ID No. 1571) |
| tgcttgcaaatagg, | (SEQ ID No. 1572) |
| ctgcttgcaaatagg, | (SEQ ID No. 1573) |
| gcaggtggatattt, | (SEQ ID No. 1574) |
| ctgctgttggcag, | (SEQ ID No. 1575) |
| cactagtttccaagt, | (SEQ ID No. 1576) |
| gttttggttcactag, | (SEQ ID No. 1577) |
| ctttgatttcaggatag, | (SEQ ID No. 1578) |
| gcacttcttctttatct, | (SEQ ID No. 1579) |
| ccaagtcagatttcc, | (SEQ ID No. 1580) |
| gtttccaagtcagatttc, | (SEQ ID No. 1581) |
| ggttcactagtttcc, | (SEQ ID No. 1582) |
| ggttttggttcactag, | (SEQ ID No. 1583) |
| ccgaaaaattgggca, | (SEQ ID No. 1584) |
| ccgaaaaattggg, | (SEQ ID No. 1585) |
| ctatccgaaaaattgg, | (SEQ ID No. 1586) |
| gttgataatgtcatcag, | (SEQ ID No. 1587) |
| ctcatgttgataatgtc, | (SEQ ID No. 1588) |
| ctgtcaccgcgtag, | (SEQ ID No. 1589) |
| cgtctcctgtcaccg, | (SEQ ID No. 1590) |
| cttcacgtctcctg, | (SEQ ID No. 1591) |
| gagaactttatcatgtc, | (SEQ ID No. 1592) |
| gctatatgcaggg, | (SEQ ID No. 1593) |
| ccagctgctatatgcagg, | (SEQ ID No. 1594) |
| aggctaaattttgcct, | (SEQ ID No. 1595) |
| ggctaaattttgcc, | (SEQ ID No. 1596) |
| ggctaaattttgccttc, | (SEQ ID No. 1597) |
| gcaggctaaattttgcc, | (SEQ ID No. 1598) |
| gagttacccaagcg, | (SEQ ID No. 1599) |
| cagagttacccaagcg, | (SEQ ID No. 1600) |
| cagagttacccaag, | (SEQ ID No. 1601) |
| acagagttacccaag, | (SEQ ID No. 1602) |
| ggtgcaaaacagag, | (SEQ ID No. 1603) |
| ctaggtgcaaaacag, | (SEQ ID No. 1604) |
| gagaactttatcatgtcc, | (SEQ ID No. 1605) |
| gctagatgaatggc, | (SEQ ID No. 1606) |
| gcaaacatggcaggc, | (SEQ ID No. 1607) |
| cagcaaacatggca, | (SEQ ID No. 1608) |
| gcagcaaacatggc, | (SEQ ID No. 1609) |
| agcagcaaacatgg, | (SEQ ID No. 1610) |
| cagcagcaaacatg, | (SEQ ID No. 1611) |
| agcagcagcaaaca, | (SEQ ID No. 1612) |
| cagcagcagcaaaca, | (SEQ ID No. 1613) |
| cagcagcagcaaac, | (SEQ ID No. 1614) |
| caccagcagcagca, | (SEQ ID No. 1615) |
| gcattgacgtcagc, | (SEQ ID No. 1616) |
| gatgttgtcgtgctc, | (SEQ ID No. 1617) |
| tgagatgttgtcgtgct, | (SEQ ID No. 1618) |
| tgagatgttgtcgtg, | (SEQ ID No. 1619) |
| gccaatgagatgttg, | (SEQ ID No. 1620) |
| ctgccaatgagatg, | (SEQ ID No. 1621) |
| cacatgggcatcac, | (SEQ ID No. 1622) |
| tgtccacatgggca, | (SEQ ID No. 1623) |
| gtactgtccacatg, | (SEQ ID No. 1624) |
| cagctgctatatgc, | (SEQ ID No. 1625) |
| gttctccaccaggg, | (SEQ ID No. 1626) |
| agttctccaccagg, | (SEQ ID No. 1627) |
| caaagttctccaccag, | (SEQ ID No. 1628) |
| ccaagagtcatccagg, | (SEQ ID No. 1629) |

-continued cccaagagtcatcc, (SEQ ID No. 1630)

cctgcattttcccaag, (SEQ ID No. 1631)

tcctgcattttccc, (SEQ ID No. 1632)

gccatatctagaggc, (SEQ ID No. 1633)

tcacatcttcagcc, (SEQ ID No. 1634)

gcttcacatcttcagc, (SEQ ID No. 1635)

cagcttcacatcttc, (SEQ ID No. 1636)

gtaacttatacagctgc, (SEQ ID No. 1637)

ccagttttgtctgg, (SEQ ID No. 1638)

ccatttgtctcagg, (SEQ ID No. 1639)

gtgtagcccatttg, (SEQ ID No. 1640)

gcttcggtgtagcc, (SEQ ID No. 1641)

gatcacttcaattgcttc, (SEQ ID No. 1642)

cttgtggaggcagg, (SEQ ID No. 1643)

gctgccttgtggag, (SEQ ID No. 1644)

ctatttgctgccttgtgg, (SEQ ID No. 1645)

ggatgtctccacgc, (SEQ ID No. 1646)

ggaaggatgtctcc, (SEQ ID No. 1647)

tgcggaaggatgtc, (SEQ ID No. 1648)

gtttgcggaaggatgtc, (SEQ ID No. 1649)

gctgagtttgcgga, (SEQ ID No. 1650)

ggtaaagctgagtttg, (SEQ ID No. 1651)

tcggtaaagctgag, (SEQ ID No. 1652)

gactcggtaaagctg, (SEQ ID No. 1653)

agagactcggtaaagc, (SEQ ID No. 1654)

gaaattgtcagcaggc, (SEQ ID No. 1655)

gaaattgtcagcagg, (SEQ ID No. 1656)

ggaaattgtcagcagg, (SEQ ID No. 1657)

ggaaattgtcagcag, (SEQ ID No. 1658)

gggaaattgtcagc, (SEQ ID No. 1659)

gtgtgggaaattgtc, (SEQ ID No. 1660)

ggtttacacggtgtg, (SEQ ID No. 1661)

gctttggtttacacg, (SEQ ID No. 1662)

gcacctttgggatgc, (SEQ ID No. 1663)

ccaggttctgcttcc, (SEQ ID No. 1664)

gctctgtctagtggc, (SEQ ID No. 1665)

actctccatgtctc, (SEQ ID No. 1666)

caactctccatgtctc, (SEQ ID No. 1667)

caactctccatgtc, (SEQ ID No. 1668)

agcaactctccatg, (SEQ ID No. 1669)

gtagcaactctccatg, (SEQ ID No. 1670)

gtagcaactctcca, (SEQ ID No. 1671)

ggttgtagcaactctcc, (SEQ ID No. 1672)

cgggcagtcctcca, (SEQ ID No. 1673)

gcaccgggcagtc, (SEQ ID No. 1674)

aggcaccgggcag, (SEQ ID No. 1675)

gtgtgttaccaggtc, (SEQ ID No. 1676)

tgtgtgttaccaggt, (SEQ ID No. 1677)

tgggtcactgtgtg, (SEQ ID No. 1678)

cagactgtgggcatg, (SEQ ID No. 1679)

cccaccagactgtggg, (SEQ ID No. 1680)

ccaccagactgtgg, (SEQ ID No. 1681)

tgcccaccagactg, (SEQ ID No. 1682)

cggcttcctcccc, (SEQ ID No. 1683)

ccttgtcttccacc, (SEQ ID No. 1684)

accgaggctgccac, (SEQ ID No. 1685)

ggaagaaaccgagg, (SEQ ID No. 1686)

gggaagaaaccgag, (SEQ ID No. 1687)

ggccatctgcgcc, (SEQ ID No. 1688)

gcggccatctgcg, (SEQ ID No. 1689)

gtggcggccatctg, (SEQ ID No. 1690)

accgtggcggccat, (SEQ ID No. 1691)

gccgctcaatcttcatc, (SEQ ID No. 1692)

cttcatcttgtgatagg, (SEQ ID No. 1693)

gctcaatcttcatcttg, (SEQ ID No. 1694)

cagaaacactgttacag, (SEQ ID No. 1695)

cagttgcagaaacactg, (SEQ ID No. 1696)

gtttcagttgcagaaac, (SEQ ID No. 1697)

cttccaccagaggg, (SEQ ID No. 1698)

gtcttccaccagag, (SEQ ID No. 1699)

cttgtcttccaccagag, (SEQ ID No. 1700)

tccttgtcttccac, (SEQ ID No. 1701)

cttccttgtcttccac, (SEQ ID No. 1702)

catcttgtgataggg, (SEQ ID No. 1703)

gctaggtgcagtggt, (SEQ ID No. 1704)

gatggctaggtgca, (SEQ ID No. 1705)

gtggatgatggctag, (SEQ ID No. 1706)

cccgtggatgatgg, (SEQ ID No. 1707)

ctgcccgtggatga, (SEQ ID No. 1708)

agagcctccaccca, (SEQ ID No. 1709)

gttgtactctcgagc, (SEQ ID No. 1710)

cgttgtactctcg, (SEQ ID No. 1711)

cgcgttgtactctc, (SEQ ID No. 1712)

gagtctccatgccg, (SEQ ID No. 1713)

ctgagtctccatgc, (SEQ ID No. 1714)

catggctgagtctc, (SEQ ID No. 1715)

tgcatggctgagtc, (SEQ ID No. 1716)

gcgttcacgttggc, (SEQ ID No. 1717)

gtgcgagcgttcac, (SEQ ID No. 1718)

aggtgcgagcgttc, (SEQ ID No. 1719)

gcaaggtgcgagc, (SEQ ID No. 1720)

cctggtggctcagg, (SEQ ID No. 1721)

gtcagtcacctgag, (SEQ ID No. 1722)

caggtcagtcacctg, (SEQ ID No. 1723)

cagcaggtcagtcac, (SEQ ID No. 1724)

gcagcaggtcagtc, (SEQ ID No. 1725)

catttagcagcaaggtc, (SEQ ID No. 1726)

gcagcatttagcagc, (SEQ ID No. 1727)

ctgagcagcatttag, (SEQ ID No. 1728)

cccatgagaatcct, (SEQ ID No. 1729)

ccttcccatgagaatcc, (SEQ ID No. 1730)

tcctcccctteccca, (SEQ ID No. 1731)

gcctccagtagacc, (SEQ ID No. 1732)

gtcagacagggcct, (SEQ ID No. 1733)

ccatgtcagacagg, (SEQ ID No. 1734)

ggcccatgtcagac, (SEQ ID No. 1735)

gctattcctgaaatcac, (SEQ ID No. 1736)

cctcttgtcttcttacc, (SEQ ID No. 1737)

ggagaagaaacctcttg, (SEQ ID No. 1738)

ccttgctgaagtttctt, (SEQ ID No. 1739)

ccaagactccttgc, (SEQ ID No. 1740)

cccctttcatggagc, (SEQ ID No. 1741)

cctcttggtgtgac, (SEQ ID No. 1742)

gactaaggatgccg, (SEQ ID No. 1743)

gtggcaggactaagg, (SEQ ID No. 1744)

agacgtggcaggac, (SEQ ID No. 1745)

cttccagcaggcag, (SEQ ID No. 1746)

gttcctctgcctgg, (SEQ ID No. 1747)

gatgttcctctgcctg, (SEQ ID No. 1748)

gagatgttcctctgcc, (SEQ ID No. 1749)

gtgagatgttcctctg, (SEQ ID No. 1750)

cagagagtgagatgttcc, (SEQ ID No. 1751)

ccagagagtgagatgtt, (SEQ ID No. 1752)

ggtccagagagtgag, (SEQ ID No. 1753)

gaggtccagagagtg, (SEQ ID No. 1754)

ggtcctgtagtgcc, (SEQ ID No. 1755)

gattttatgatgcaggc, (SEQ ID No. 1756)

gacctgcatcccttattg, (SEQ ID No. 1757)

tagttgattttccagcag, (SEQ ID No. 1758)

gaatctcacgttttgc, (SEQ ID No. 1759)

cagagaaagaatctcacg, (SEQ ID No. 1760)

tttcaccatcagagaaag, (SEQ ID No. 1761)

catttggacatttcacc, (SEQ ID No. 1762)

ccttcatttggacatttc, (SEQ ID No. 1763)

caatgtgcttgatgatcc, (SEQ ID No. 1764)

cgcatcggatttctc, (SEQ ID No. 1765)

caaaccgcatcggatttc, (SEQ ID No. 1766)

gaactgcaaaccgc, (SEQ ID No. 1767)

gcagagaagaactgc, (SEQ ID No. 1768)

gcaagtaaacatggg, (SEQ ID No. 1769)

ggtccacgttttgg, (SEQ ID No. 1770)

gcaagggtccacgttt, (SEQ ID No. 1771)

tggcttcttcttcaggg, (SEQ ID No. 1772)

tcctgctggcttctttc, (SEQ ID No. 1773)

gtcctgctggcttc, (SEQ ID No. 1774)

ggtagtctaggaattgg, (SEQ ID No. 1775)

cttgcaggtagtctagg, (SEQ ID No. 1776)

gaaactcttgcaggtag, (SEQ ID No. 1777)

caccaagaaactcttgc, (SEQ ID No. 1778)

cattacaccaagaaactc, (SEQ ID No. 1779)

ctcggtgttcattacacc, (SEQ ID No. 1780)

cttttctattatccactcg, (SEQ ID No. 1781)

ccagtttagtctcaactt, (SEQ ID No. 1782)

aaccagtttagtctcaac, (SEQ ID No. 1783)

acaaaccagtttagtctc, (SEQ ID No. 1784)

ctcgcgaaaaagtttctt, (SEQ ID No. 1785)

ccctcgcgaaaaagtttc, (SEQ ID No. 1786)

gtccctcgcgaaaaag, (SEQ ID No. 1787)

cagttgaaccgtccc, (SEQ ID No. 1788)

gctttcgaagtttcagtt, (SEQ ID No. 1789)

gatgctttcgaagtttc, (SEQ ID No. 1790)

ctgtctctgcaaataatg, (SEQ ID No. 1791)

| | |
|---|---|
| cacttattacattcaccc, | (SEQ ID No. 1792) |
| ttttcctccagttcctc, | (SEQ ID No. 1793) |
| ggacaatatgtacaaaactc, | (SEQ ID No. 1794) |
| gttgatgaacatttggac, | (SEQ ID No. 1795) |
| gtgttgatgaacatttgg, | (SEQ ID No. 1796) |
| caaaatttggccaggg, | (SEQ ID No. 1797) |
| gcccaaaatttggcc, | (SEQ ID No. 1798) |
| cccagcccaaaatttgg, | (SEQ ID No. 1799) |
| gtccccagcccaaaatt, | (SEQ ID No. 1800) |
| aaatcgccagaggctg, | (SEQ ID No. 1801) |
| accaaatcgccagagg, | (SEQ ID No. 1802) |
| catcaccaaatcgccag, | (SEQ ID No. 1803) |
| taggagtggttgaggc, | (SEQ ID No. 1804) |
| gtgtaggagtggttgag, | (SEQ ID No. 1805) |
| ctgtgtaggagtgg, | (SEQ ID No. 1806) |
| cccacatgcctgtg, | (SEQ ID No. 1807) |
| cgatgaacaacgag, | (SEQ ID No. 1808) |
| ctggcgatgaacaacg, | (SEQ ID No. 1809) |
| cgctggcgatgaac, | (SEQ ID No. 1810) |
| gagctagtcccgttg, | (SEQ ID No. 1811) |
| gcgaagagctagtcc, | (SEQ ID No. 1812) |
| ccagttatgcgaagagc, | (SEQ ID No. 1813) |
| ccccagttatgcgaag, | (SEQ ID No. 1814) |
| cacatgcttggcgc, | (SEQ ID No. 1815) |
| gatcacatgcttggcg, | (SEQ ID No. 1816) |
| gacaaagagcatgatcac, | (SEQ ID No. 1817) |
| gagtcacagggacaaag, | (SEQ ID No. 1818) |
| gagagtcacagggac, | (SEQ ID No. 1819) |
| gcagagagtcacagg, | (SEQ ID No. 1820) |
| ccatgcagagagtc, | (SEQ ID No. 1821) |
| ccaccatgcagagag, | (SEQ ID No. 1822) |
| tagccacgaccacc, | (SEQ ID No. 1823) |
| gattagctgcccatcctt, | (SEQ ID No. 1824) |
| ggtatagattagctgcc, | (SEQ ID No. 1825) |
| gtatcttctgtgaatggg, | (SEQ ID No. 1826) |
| ctggcccacagtct, | (SEQ ID No. 1827) |
| ctctggcccacagt, | (SEQ ID No. 1828) |
| tgcagggctctctg, | (SEQ ID No. 1829) |
| agtgcagggctctc, | (SEQ ID No. 1830) |
| cactgatcatgatggc, | (SEQ ID No. 1831) |
| gacactgatcatgatggc, | (SEQ ID No. 1832) |
| acaatgacactgatcatg, | (SEQ ID No. 1833) |
| gaaccaccaggaggat, | (SEQ ID No. 1834) |
| gacacaaaacagccact, | (SEQ ID No. 1835) |
| gtggacctttcggac, | (SEQ ID No. 1836) |
| caaccagcatacgaagt, | (SEQ ID No. 1837) |
| tccctctgggcttc, | (SEQ ID No. 1838) |
| actgtccctctggg, | (SEQ ID No. 1839) |
| gactgtccctctgg, | (SEQ ID No. 1840) |
| cctagatgactgtccc, | (SEQ ID No. 1841) |
| cagcgaggatactgc, | (SEQ ID No. 1842) |
| cttcaccagcgaggat, | (SEQ ID No. 1843) |
| tttcctctgggtcttcac, | (SEQ ID No. 1844) |
| ctttcctctgggtcttc, | (SEQ ID No. 1845) |
| ctcccaatccaagtttt, | (SEQ ID No. 1846) |
| ttcatcccggagcc, | (SEQ ID No. 1847) |
| ttcttcatcccggagc, | (SEQ ID No. 1848) |
| gctcagccagttcttc, | (SEQ ID No. 1849) |
| gacagagagggcac, | (SEQ ID No. 1850) |
| cttcacctccgacag, | (SEQ ID No. 1851) |
| gaaaagtctgggcagg, | (SEQ ID No. 1852) |
| gaccctggaacagaaaag, | (SEQ ID No. 1853) |
| ctgaccctggaacag, | (SEQ ID No. 1854) |
| actacaggctgaccct, | (SEQ ID No. 1855) |
| attcactacaggctgacc, | (SEQ ID No. 1856) |
| cgattcactacagg, | (SEQ ID No. 1857) |
| ggccgattcactac, | (SEQ ID No. 1858) |
| cgaacgtctgttggtc, | (SEQ ID No. 1859) |
| cgcgaacgtctgttg, | (SEQ ID No. 1860) |
| cttctgtttgtcgaggat, | (SEQ ID No. 1861) |
| ttcaccaccttctgtttg, | (SEQ ID No. 1862) |
| aggatgcgcttttcattc, | (SEQ ID No. 1863) |
| agcttgcaggatgcg, | (SEQ ID No. 1864) |
| gttgacagcttgcaggat, | (SEQ ID No. 1865) |
| ggaacggaaagttgacag, | (SEQ ID No. 1866) |
| aactcgagtttgacgagg, | (SEQ ID No. 1867) |
| tgtccttgaaggagaac, | (SEQ ID No. 1868) |
| cgtactccatgaccatgt, | (SEQ ID No. 1869) |
| gcacgtactccatgac, | (SEQ ID No. 1870) |
| gattctccggcttcag, | (SEQ ID No. 1871) |
| tcaatgagcagattctcc, | (SEQ ID No. 1872) |

| | |
|---|---|
| ggtcaatgagcagattc, | (SEQ ID No. 1873) |
| ccctgctggtcaatg, | (SEQ ID No. 1874) |
| tagccctgctggtc, | (SEQ ID No. 1875) |
| cgcttggcgaaacc, | (SEQ ID No. 1876) |
| ccttcacgcgcttg, | (SEQ ID No. 1877) |
| aaggtccaagtgcg, | (SEQ ID No. 1878) |
| tgccgcacaaggtc, | (SEQ ID No. 1879) |
| ggtgaggaccaccattt, | (SEQ ID No. 1880) |
| gggtgtcacaggtg, | (SEQ ID No. 1881) |
| ataccatcttcttcaggg, | (SEQ ID No. 1882) |
| ggtgataccatcttcttc, | (SEQ ID No. 1883) |
| ccaggtgataccatcttc, | (SEQ ID No. 1884) |
| cctcactgctctggt, | (SEQ ID No. 1885) |
| taagacctcactgc, | (SEQ ID No. 1886) |
| cagagcctaagacctc, | (SEQ ID No. 1887) |
| ccagagcctaagacc, | (SEQ ID No. 1888) |
| tcttccttttgtgaagc, | (SEQ ID No. 1889) |
| gaccaaattccatcttcc, | (SEQ ID No. 1890) |
| atcagtggaccaaattcc, | (SEQ ID No. 1891) |
| ggttctttctggtcctttt, | (SEQ ID No. 1892) |
| tttttgggttctttctgg, | (SEQ ID No. 1893) |
| ggtcttattttgggttc, | (SEQ ID No. 1894) |
| aatgggcagactctcct, | (SEQ ID No. 1895) |
| tccaccatgacctcaatg, | (SEQ ID No. 1896) |
| aacggcatccaccatg, | (SEQ ID No. 1897) |
| gtgaacggcatccac, | (SEQ ID No. 1898) |
| acttgagcttgtgaacgg, | (SEQ ID No. 1899) |
| ttcatacttgagcttgtg, | (SEQ ID No. 1900) |
| ctggtgtagttttcatac, | (SEQ ID No. 1901) |
| agctgctggtgtagtttt, | (SEQ ID No. 1902) |
| aggaggaccagggt, | (SEQ ID No. 1903) |
| aggtggtccaggag, | (SEQ ID No. 1904) |
| tttctggccaaactgagg, | (SEQ ID No. 1905) |
| ggaggtttctggcc, | (SEQ ID No. 1906) |
| tctggagtggccac, | (SEQ ID No. 1907) |
| cttctggagcatgttgct, | (SEQ ID No. 1908) |
| gccttctggagcatg, | (SEQ ID No. 1909) |
| gtttgtctggccttctg, | (SEQ ID No. 1910) |
| gagtttgtctggccttct, | (SEQ ID No. 1911) |
| ctagagtttgtctggcct, | (SEQ ID No. 1912) |
| gcaagggtaaaattctag, | (SEQ ID No. 1913) |
| agtgcaagggtaaaattc, | (SEQ ID No. 1914) |
| aaacaggcctccact, | (SEQ ID No. 1915) |
| cttggttaattccaatgg, | (SEQ ID No. 1916) |
| aggcaactcccattagtt, | (SEQ ID No. 1917) |
| tactactaaggcacaggg, | (SEQ ID No. 1918) |
| aatactactaaggcacag, | (SEQ ID No. 1919) |
| gtacatcttcaagtcttc, | (SEQ ID No. 1920) |
| ggagtggacatgat, | (SEQ ID No. 1921) |
| aagaagatgaagcctttg, | (SEQ ID No. 1922) |
| ccgtcttactcttcttgg, | (SEQ ID No. 1923) |
| ccgatacaattccaagg, | (SEQ ID No. 1924) |
| ccttttccttctgag, | (SEQ ID No. 1925) |
| ctgttgcaagtacg, | (SEQ ID No. 1926) |
| cagaagcagagggc, | (SEQ ID No. 1927) |
| cctcagaagcagagg, | (SEQ ID No. 1928) |
| ctcctcagaagcag, | (SEQ ID No. 1929) |
| acaggctggtggca, | (SEQ ID No. 1930) |
| ccactctcaaacaggc, | (SEQ ID No. 1931) |
| acggtagccgaagc, | (SEQ ID No. 1932) |
| gacggtagccgaagc, | (SEQ ID No. 1933) |
| ggccagacggtagc, | (SEQ ID No. 1934) |
| gtgtagggccagacggta, | (SEQ ID No. 1935) |
| ccgaagccatttttcagg, | (SEQ ID No. 1936) |
| ccccgaagccatttttc, | (SEQ ID No. 1937) |
| ggttgatgtcgtcc, | (SEQ ID No. 1938) |
| gcttgagacactcgc, | (SEQ ID No. 1939) |
| ccggacccgtccat, | (SEQ ID No. 1940) |
| gcttgctttactgc, | (SEQ ID No. 1941) |
| ggttgctctgagac, | (SEQ ID No. 1942) |
| gccacagtcatgcc, | (SEQ ID No. 1943) |
| cgggcatgctggcg, | (SEQ ID No. 1944) |
| gtgaagttcaggatgatc, | (SEQ ID No. 1945) |
| ccagtgcctcatgg, | (SEQ ID No. 1946) |
| cagtgttctccatgg, | (SEQ ID No. 1947) |
| ctgtaccagaccgag, | (SEQ ID No. 1948) |
| gcatactgtttcagc, | (SEQ ID No. 1949) |
| gccatcagctccttg, | (SEQ ID No. 1950) |
| ccacaccatagatgg, | (SEQ ID No. 1951) |
| gctggagcagtttcc, | (SEQ ID No. 1952) |
| ctcgcttctgctgc, | (SEQ ID No. 1953) |

| Sequence | ID |
|---|---|
| accgtggcaaagcg, | (SEQ ID No. 1954) |
| aggtgacaccgtgg, | (SEQ ID No. 1955) |
| gacttgattccttcag, | (SEQ ID No. 1956) |
| ggatttgacttgattcc, | (SEQ ID No. 1957) |
| gctgctgttcatgg, | (SEQ ID No. 1958) |
| ccgtttctttcagtagg, | (SEQ ID No. 1959) |
| cttgaagtaggagc, | (SEQ ID No. 1960) |
| cgctcctacatggc, | (SEQ ID No. 1961) |
| gatgaggtacaggcc, | (SEQ ID No. 1962) |
| gtagatgaggtacag, | (SEQ ID No. 1963) |
| gagtagatgaggtac, | (SEQ ID No. 1964) |
| cctgggagtagatg, | (SEQ ID No. 1965) |
| ggacctgggagtag, | (SEQ ID No. 1966) |
| acatgggtggaggg, | (SEQ ID No. 1967) |
| gtgctcatggtgtc, | (SEQ ID No. 1968) |
| ctttcagtgctcatg, | (SEQ ID No. 1969) |
| tgctttcagtgctca, | (SEQ ID No. 1970) |
| gatgatctgactgcc, | (SEQ ID No. 1971) |
| gttcgagaagatgatc, | (SEQ ID No. 1972) |
| gggttcgagaagatg, | (SEQ ID No. 1973) |
| ggtttgctacaacatg, | (SEQ ID No. 1974) |
| cagcttgagggtttg, | (SEQ ID No. 1975) |
| tgcccctcagcttg, | (SEQ ID No. 1976) |
| gacacacactatctc, | (SEQ ID No. 1977) |
| gcagccatctttattc, | (SEQ ID No. 1978) |
| gttcagcagccatc, | (SEQ ID No. 1979) |
| tggttcagcagcca, | (SEQ ID No. 1980) |
| ctactggttcagcagc, | (SEQ ID No. 1981) |
| tctactggttcagc, | (SEQ ID No. 1982) |
| gccacaaagttgatgc, | (SEQ ID No. 1983) |
| cattgccacaaagttg, | (SEQ ID No. 1984) |
| gagaacttggtcattc, | (SEQ ID No. 1985) |
| ggtcaatgaagagaac, | (SEQ ID No. 1986) |
| cgatttccttggtc, | (SEQ ID No. 1987) |
| ccgatttccttggtc, | (SEQ ID No. 1988) |
| caaatagaggccgatttc, | (SEQ ID No. 1989) |
| caaatagaggccga, | (SEQ ID No. 1990) |
| cctctaggctggct, | (SEQ ID No. 1991) |
| catacctctaggctg, | (SEQ ID No. 1992) |
| agccatacctctag, | (SEQ ID No. 1993) |
| cagccatacctctag, | (SEQ ID No. 1994) |
| cacagagatagttacag, | (SEQ ID No. 1995) |
| gtcttcgttttgaacag, | (SEQ ID No. 1996) |
| ctagtcttcgttttgaac, | (SEQ ID No. 1997) |
| tagctagtcttcgttttg, | (SEQ ID No. 1998) |
| gagccactgcgcc, | (SEQ ID No. 1999) |
| cgtgagccactgcg, | (SEQ ID No. 2000) |
| cgtaacgatcactgg, | (SEQ ID No. 2001) |
| gcactcgtaacgatc, | (SEQ ID No. 2002) |
| ggagcactcgtaac, | (SEQ ID No. 2003) |
| catcatcctgaggt, | (SEQ ID No. 2004) |
| cagtatcatcatcctg, | (SEQ ID No. 2005) |
| ctcagtatcatcatcc, | (SEQ ID No. 2006) |
| ctaaaagtatgtgccatc, | (SEQ ID No. 2007) |
| cacatcgcctctct, | (SEQ ID No. 2008) |
| gcttcacagtcacatcgc, | (SEQ ID No. 2009) |
| ggaaggcttcacagtc, | (SEQ ID No. 2010) |
| cctgtgacttgagaattg, | (SEQ ID No. 2011) |
| ggaagacctgtgac, | (SEQ ID No. 2012) |
| ctctgctccacatatttg, | (SEQ ID No. 2013) |
| caacgaagatctctg, | (SEQ ID No. 2014) |
| caacaccaacgaag, | (SEQ ID No. 2015) |
| ggtcttctgtttgc, | (SEQ ID No. 2016) |
| cgatgaagtggtaggaag, | (SEQ ID No. 2017) |
| ggttgcatggaagc, | (SEQ ID No. 2018) |
| ggtcacaaacttgcc, | (SEQ ID No. 2019) |
| ctgatttggtccactag, | (SEQ ID No. 2020) |
| catgttagcactgttc, | (SEQ ID No. 2021) |
| ggtcttgatgtactcc, | (SEQ ID No. 2022) |
| ccacctaaagagagatc, | (SEQ ID No. 2023) |
| cttgtactgcaccatc, | (SEQ ID No. 2024) |
| gccagttaagaagatg, | (SEQ ID No. 2025) |
| gagatcatgatccatgg, | (SEQ ID No. 2026) |
| gtagtgtcccaatagtg, | (SEQ ID No. 2027) |
| cttcctcatcattccc, | (SEQ ID No. 2028) |
| cacaagcttttcgac, | (SEQ ID No. 2029) |

Example 14

Combination of a 5'- and 3'-End PEG Modified Conjugate with a Third Component Penetratin Starting product was a pyridyl-activated 5'-/3'-end PEG modified oligonucleotide, wherein the 5'-end was modified via native ligation, which is described as mPEG400-NH-Cys (SPy)-Oligo-NH-mPEG1000. The oligonucleotides connected to penetratin were selected from the group consisting of sequences of FIG. 1 and Example 13, preferably of SEQ ID No. 2030, 2031, 2032, 2057, 2066, and 2461.

Penetratin had the following sequence: $H_2N$-RQIKIW-FQNRRMKWKKC-COOH (SEQ ID NO: 2462), wherein the cysteine at the C-terminus was additionally added to improve the connection between penetratin and the native ligation site of mPEG400-NH-Cys(SPy)-Oligo-NH-mPEG1000.

20 nmol of mPEG400-NH-Cys(SPy)-Oligo-NH-mPEG1000 were dissolved in formamide to a final oligonucleotide concentration of 0.05 nmol/µl (0.05 mM), which was added to 1 nmol penetration. The mixture of mPEG400-NH-Cys(SPy)-Oligo-NH-mPEG1000 and penetratin was incubated at 37° C. for 30 min, and afterwards purified via anion exchange column and a reverse phase HPLC. The results are shown in FIG. 13A to C, wherein the oligonucleotide of SEQ ID No. 2461 was the selected.

Using the same, above mentioned conditions, a PEG-modified oligonucleotide of SEQ ID No. 2030 was connected to penetration via the native ligation site. SEQ ID No. 2030 like SEQ ID No. 2461 show a highly efficient combination with penetratin. The results for SEQ ID No. 2030 are shown in FIG. 13A to C and 14A to C.

The final products mPEG400-Cys(S-Pen)-Oligo-NH-mPEG1000 were confirmed in a MALDI-TOF MS having a matrix of 2,6 dihydroxyacetophenone (DHAP) and diammoniumhydrogencitrate.

Example 15

Combination of a 5'- and 3'-End PEG Modified Conjugate and the RGDC Peptide

Starting product was a pyridyl-activated 5'-/3'-end PEG modified oligonucleotide, wherein the 5'-end was modified via native ligation, which is described as mPEG400-Cys(SPy)-Oligo-mPEG1000. The oligonucleotides connected to RGDC were selected from the group consisting of sequences of FIG. 1 and Example 13, preferably of SEQ ID No. 2030, 2031, 2032, 2057, 2066, and 2461.

The activated RGDC peptide comprises an additional C-terminal cysteine and had the following sequence: $H_2N$-RGDC-COOH.

50 nmol of mPEG400-Cys(SPy)-Oligo-mPEG1000 were dissolved in 0.1 M TEAA buffer, pH 7.5 to a final oligonucleotide concentration of 0.05 nmol/µl (0.05 mM). An aqeuous solution of RGDC peptide (10 nmol/µl) was added to the modified oligonucleotide in a 0.5×, 2×, 8×, and 16× excess. The mixture of mPEG400-Cys(SPy)-Oligo-mPEG1000 and RGDC peptide was incubated at 37° C. for 1 h, and afterwards purified via reverse phase HPLC. The results are shown in FIG. 16A to C for an oligonucleotide of SEQ ID No. 2030.

The final product mPEG400-Cys(S-CDGR)-Oligo-mPEG1000 was confirmed in a MALDI-TOF MS having a matrix of 2,6 dihydroxyacetophenone (DHAP) and diammoniumhydrogencitrate.

Example 16

Effects of PEG- and RGD-Modified Oligonucleotides on Glioblastoma Cells

The commercially available human glioblastoma cell line A-172 (Accession no. CRL-1620) was established from a 53-year old man with a glioblastoma by Giard in the year 1973.

A-172 cells were obtained from Cell Lines Service (CLS). These adherent cells were grown in monolayers.

A-172 glioblastoma cells (7000 cells/well; three wells for each condition) were seeded in growth medium (DMEM-medium supplemented with 10% fetal bovine serum) in 48-well tissue culture plates and cultivated at 37° C. in 5% $CO_2$ atmosphere with a relative humidity >90%.

6 hours after cell seeding, the supernatants were removed and replaced by treatment solution consisting of growth medium (untreated cells) or growth medium supplemented with 0 µM, 0.25 µM, 0.5 µM, 1 µM, 2.5 µM, 5 µM, or 10 µM of AP12009 or derivative #26, or #28. Derivative #26 is 5'-/3'-end PEG modified AP12009 via native ligation, i.e., mPEG400-AP12009-mPEG1000 and derivative #28 is 5'-/3'-end PEG modified AP 12009 connected to RGD at the native ligation site, i.e., mPEG400-Cys(S-CDGR)-AP12009-mPEG1000.

Replacement of treatment solutions was repeated 2 days and 4 days after the first treatment. On day 7 supernatants were collected, cleared of cellular components by centrifugation (300×g, 5 min, ambient temperature), and frozen immediately at −20° C. Cell number was determined using for example the CyQuant Direct Cell Proliferation Assay kit (Invitrogen (Karlsruhe, Germany) according to the instructions of the manufacturer.

Secreted TGF-beta2 was measured using for example the Quantikinea Human TGF-β2-ELISA Kit, (R&D Systems) according to the instructions of the manufacturer.

Derivative #26 (light grey column) is more effective than AP12009 (black column) at 1 and 2.5 µM in suppressing TGF-beta2 expression as shown in FIG. 17A. Derivative #28 (dark grey column) is even more effective than derivative #26 in suppressing TGF-beta2 expression, especially at lower concentration ranges, e.g., 0.5 µM. In the concentration range of 0 to 10 µM AP12009, derivative #26, or derivative #28 have almost no effect on the proliferation of these cells as shown in FIG. 17B. The comparison of proliferation and TGF-beta suppression indicates a specific TGF-beta suppression independent from proliferation.

Example 17

Combination of a 5'- and 3'-end PEG modified conjugate and Fluorescein

Starting product was a 5'-/3'-end PEG modified oligonucleotide, wherein the 5'-end was modified via native ligation, which is described as mPEG400-Cys(SPy)-Oligo-mPEG1000. The oligonucleotides connected to RGDC were selected from the group consisting of sequences of FIG. 1 and Example 13, preferably of SEQ ID No. 2030, 2031, 2032, 2057, 2066 and 2461.

43 nmol of mPEG400-Cys(SPy)-Oligo-mPEG1000 were dissolved in 50 mM Tris/150 mM NaCl/5 mM EDTA pH 8.5 resulting in an oligonucleotide concentration of 0.25 nmol/µl. 129 nmol Fluorescein-Iodoacetat in 50 mM Tris/150 mM NaCl/5 mM EDTA pH 8.5 were added to the modified oligonucleotide and incubated for 30 min. at room temperature. Afterwards the samples were purified via reverse phase HPLC. The results are shown in FIG. 19 for an oligonucleotide of SEQ ID No. 2030.

The final product mPEG400-Cys(S-Fluorescein)-Oligo-mPEG1000 was confirmed in a MALDI-TOF MS having a matrix of 2,6 dihydroxyacetophenone (DHAP) and diammoniumhydrogencitrate.

SEQUENCE LISTING (2462 sequences)

SEQ ID NO: 1 - DNA, 20 bp, Artificial Sequence
  Antisense nucleotide
gtgccatcaatacctgcaaa

SEQ ID NO: 2 - DNA, 20 bp, Artificial Sequence
  Antisense nucleotide
catcagttacatcgaaggag

SEQ ID NO: 3 - DNA, 20 bp, Artificial Sequence
  Antisense nucleotide
tcttgggacacgcagcaagg

SEQ ID NO: 4 - DNA, 20 bp, Artificial Sequence
  Antisense nucleotide
gaaatcaatgtaaagtggac

SEQ ID NO: 5 - DNA, 20 bp, Artificial Sequence
  Antisense nucleotide
catgaactggtccatatcga

SEQ ID NO: 6 - DNA, 20 bp, Artificial Sequence
  Antisense nucleotide
gaggttctaaatcttgggac

SEQ ID NO: 7 - DNA, 20 bp, Artificial Sequence
  Antisense nucleotide
gcactctggcttttgggttc

SEQ ID NO: 8 - DNA, 20 bp, Artificial Sequence
  Antisense nucleotide
tagctcaatccgttgttcag

SEQ ID NO: 9 - DNA, 20 bp, Artificial Sequence
  Antisense nucleotide
ccctagatccctcttgaaat

SEQ ID NO: 10 - DNA, 20 bp, Artificial Sequence
  Antisense nucleotide
accaaggctctcttatgttt

SEQ ID NO: 11 - DNA, 20 bp, Artificial Sequence
  Antisense nucleotide
tcgagtgtgctgcaggtaga

SEQ ID NO: 12 - DNA, 20 bp, Artificial Sequence
  Antisense nucleotide
tgaacagcatcagttacatc

SEQ ID NO: 13 - DNA, 20 bp, Artificial Sequence
  Antisense Nucleotide
gctgggttggagatgttaaa

SEQ ID NO: 14 - DNA, 20 bp, Artificial Sequence
  Antisense nucleotide
agaggttctaaatcttggga

SEQ ID NO: 15 - DNA, 20 bp, Artificial Sequence
  Antisense Nucleotide
cgccggttggtctgttgtga

SEQ ID NO: 16 - DNA, 20 bp, Artificial Sequence
  Antisense Nucleotide
ctgctttcaccaaattggaa

SEQ ID NO: 17 - DNA, 20 bp, Artificial Sequence
  Antisense nucleotide
aagtatagatcaaggagagt

SEQ ID NO: 18 - DNA, 20 bp, Artificial Sequence
  Antisense nucleotide
tgctcaggatctgcccgcgg

SEQ ID NO: 19 - DNA, 20 bp, Artificial Sequence
  Antisense nucleotide
gtgctgttgtagatggaaat

SEQ ID NO: 20 - DNA, 20 bp, Artificial Sequence
  Antisense nucleotide
agggcggcatgtctattttg

SEQ ID NO: 21 - DNA, 20 bp, Artificial Sequence
  Antisense nucleotide
taagcttattttaaatccca

SEQ ID NO: 22 - DNA, 20 bp, Artificial Sequence
  Antisense nucleotide
tagctgcatttgcaagactt

SEQ ID NO: 23 - DNA, 20 bp, Artificial Sequence
  Antisense nucleotide
tctgttgtgactcaagtctg

SEQ ID NO: 24 - DNA, 20 bp, Artificial Sequence
  Antisense nucleotide
aagcaataggccgcatccaa

SEQ ID NO: 25 - DNA, 20 bp, Artificial Sequence
  Antisense nucleotide
tcaatgtaaagtggacgtag

SEQ ID NO: 26 - DNA, 20 bp, Artificial Sequence
  Antisense nucleotide
attttagctgcatttgcaag

SEQ ID NO: 27 - DNA, 20 bp, Artificial Sequence
  Antisense nucleotide
tgtagatggaaatcacctcc

SEQ ID NO: 28 - DNA, 20 bp, Artificial
  Antisense nucleotide
ttaacactgatgaaccaagg

SEQ ID NO: 29 - DNA, 20 bp, Artificial Sequence
  Antisense nucleotide
attgtaccctttgggttcgt

SEQ ID NO: 30 - DNA, 20 bp, Artificial Sequence
  Antisense nucleotide
agatccctcttgaaatcaat

SEQ ID NO: 31 - DNA, 20 bp, Artificial Sequence
  Antisense nucleotide
tgtaaagtggacgtaggcag

SEQ ID NO: 32 - DNA, 20 bp, Artificial Sequence
  Antisense nucleotide
ccattcgccttctgctcttg

SEQ ID NO: 33 - DNA, 20 bp, Artificial Sequence
  Antisense nucleotide
tgttaaatctttggacttga

SEQ ID NO: 34 - DNA, 20 bp, Artificial Sequence
  Antisense nucleotide
gaagggcggcatgtctattt

SEQ ID NO: 35 - DNA, 20 bp, Artificial Sequence
  Antisense nucleotide
gaccctgctgtgctgagtgt

SEQ ID NO: 36 - DNA, 20 bp, Artificial Sequence
  Antisense nucleotide
gaactagtaccgccttttca

SEQ ID NO: 37 - DNA, 20 bp, Artificial Sequence
  Antisense nucleotide
cgatcctcttgcgcatgaac

SEQ ID NO: 38 - DNA, 20 bp, Artificial Sequence
  Antisense nucleotide
ccggccaaaagggaagagat

SEQ ID NO: 39 - DNA, 20 bp, Artificial Sequence
  Antisense nucleotide
aaagagacgagtggctatta

SEQ ID NO: 40 - DNA, 20 bp, Artificial Sequence
  Antisense nucleotide
aagtggaaatattaatacgg

SEQ ID NO: 41 - DNA, 20 bp, Artificial Sequence
  Antisense nucleotide
agatcaaggagagttgtttg

SEQ ID NO: 42 - DNA, 20 bp, Artificial Sequence
  Antisense nucleotide
agttgtttttaaaagtcaga

SEQ ID NO: 43 - DNA, 20 bp, Artificial Sequence
  Antisense nucleotide
tgtaacaactgggcagacag

SEQ ID NO: 44 - DNA, 20 bp, Artificial Sequence
  Antisense nucleotide
ggtgttgtaacaactgggca

SEQ ID NO: 45 - DNA, 20 bp, Artificial Sequence
  Antisense nucleotide
tacccacagagcacctggga

SEQ ID NO: 46 - DNA, 20 bp, Artificial Sequence
  Antisense nucleotide
gggatggcatcaaggtaccc

SEQ ID NO: 47 - DNA, 20 bp, Artificial Sequence
  Antisense nucleotide
tcgtcatcatcattatcatc

SEQ ID NO: 48 - DNA, 20 bp, Artificial
  Antisense nucleotide
aagggtgcctattgcatagc

SEQ ID NO: 49 - DNA, 20 bp, Artificial Sequence
  Antisense nucleotide
ctcactgttaactctaagag

SEQ ID NO: 50 - DNA, 20 bp, Artificial Sequence
  Antisense nucleotide
gcaaagtatttggtctccac

SEQ ID NO: 51 - DNA, 20 bp, Artificial Sequence
  Antisense nucleotide
caagttccttaagccatcca

SEQ ID NO: 52 - DNA, 20 bp, Artificial Sequence
  Antisense nucleotide
ttatcttaatgcagactttc

SEQ ID NO: 53 - DNA, 20 bp, Artificial Sequence
  Antisense nucleotide
cttacaagaagcttccttag

SEQ ID NO: 54 - DNA, 20 bp, Artificial Sequence
  Antisense nucleotide
actggtgagcttcagcttgc

SEQ ID NO: 55 - DNA, 20 bp, Artificial Sequence
  Antisense nucleotide
acttgagaatctgatatagc

SEQ ID NO: 56 - DNA, 20 bp, Artificial Sequence
  Antisense nucleotide
aggttcctgtctttatggtg

SEQ ID NO: 57 - DNA, 20 bp, Artificial Sequence
  Antisense nucleotide
gtgtatccatttccacccta

SEQ ID NO: 58 - DNA, 20 bp, Artificial Sequence
  Antisense nucleotide
cagcacagaagttggcattg

SEQ ID NO: 59 - DNA, 20 bp, Artificial Sequence
  Antisense nucleotide
gcaaggagaagcagatgctt

SEQ ID NO: 60 - DNA, 20 bp, Artificial Sequence
  Antisense nucleotide
agcaaggagaagcagatgct

SEQ ID NO: 61 - DNA, 20 bp, Artificial Sequence
  Antisense nucleotide
ttttccaagaattttagctg

SEQ ID NO: 62 - DNA, 20 bp, Artificial Sequence
  Antisense nucleotide
ttcttgttacaagcatcatc

SEQ ID NO: 63 - DNA, 20 bp, Artificial Sequence
  Antisense nucleotide
ttaaagaaggagcggttcgg

SEQ ID NO: 64 - DNA, 20 bp, Artificial Sequence
  Antisense nucleotide
ctgggctgaaatttatatat

SEQ ID NO: 65 - DNA, 20 bp, Artificial Sequence
  Antisense nucleotide
gggcagacagctaggagttt

SEQ ID NO: 66 - DNA, 20 bp, Artificial Sequence
  Antisense nucleotide
gtgtactcaccaaggtaccc

SEQ ID NO: 67 - DNA, 20 bp, Artificial Sequence
  Antisense nucleotide
cccagcactttgggaggccg

SEQ ID NO: 68 - DNA, 20 bp, Artificial Sequence
  Antisense nucleotide
ggctcacgcctgtaatccca

SEQ ID NO: 69 - DNA, 20 bp, Artificial Sequence
  Antisense nucleotide
tgaccgtgaactcactattt

SEQ ID NO: 70 - DNA, 20 bp, Artificial Sequence
  Antisense nucleotide
atagtggtgatggctataca

SEQ ID NO: 71 - DNA, 20 bp, Artificial Sequence
  Antisense nucleotide
ttttggttacctgcaaatct

SEQ ID NO: 72 - DNA, 20 bp, Artificial Sequence
  Antisense nucleotide
gaacactcaccctgctgtgc

SEQ ID NO: 73 - DNA, 20 bp, Artificial Sequence
  Antisense nucleotide
gaatggctctttaaacccta

SEQ ID NO: 74 - DNA, 20 bp, Artificial Sequence
  Antisense nucleotide
gaagaaatggagttcagtgt

SEQ ID NO: 75 - DNA, 20 bp, Artificial Sequence
  Antisense nucleotide
tttctcctggaagggagagg

SEQ ID NO: 76 - DNA, 20 bp, Artificial Sequence
  Antisense nucleotide
aaatgcaacgcgttcccaac

SEQ ID NO: 77 - DNA, 20 bp, Artificial Sequence
  Antisense nucleotide
aatacgaaacttttgcaaag

SEQ ID NO: 78 - DNA, 20 bp, Artificial Sequence
  Antisense nucleotide
actagtaattctcagagcgg

SEQ ID NO: 79 - DNA, 20 bp, Artificial Sequence
  Antisense nucleotide
aagaaactagtaattctcag

SEQ ID NO: 80 - DNA, 20 bp, Artificial Sequence
  Antisense nucleotide
agtgcatgtttttaaaagga

SEQ ID NO: 81 - DNA, 20 bp, Artificial Sequence
  Antisense nucleotide
cagtagtgcatgtttttaaa

SEQ ID NO: 82 - DNA, 20 bp, Artificial Sequence
  Antisense nucleotide
ctcagcacacagtagtgcat

SEQ ID NO: 83 - DNA, 20 bp, Artificial Sequence
  Antisense nucleotide
agatgcaggagcaaaaaggt

SEQ ID NO: 84 - DNA, 20 bp, Artificial
  Antisense nucleotide
caggtagacagactgagcgc

SEQ ID NO: 85 - DNA, 20 bp, Artificial Sequence
  Antisense nucleotide
gcctcgatcctcttgcgcat

SEQ ID NO: 86 - DNA, 20 bp, Artificial Sequence
  Antisense nucleotide
gcggatggcctcgatcctct

SEQ ID NO: 87 - DNA, 20 bp, Artificial Sequence
  Antisense nucleotide
ctcaggatctgcccgcggat

SEQ ID NO: 88 - DNA, 20 bp, Artificial Sequence
  Antisense nucleotide
gctccggatagtcttccggg

SEQ ID NO: 89 - DNA, 20 bp, Artificial Sequence
  Antisense nucleotide
agatggaaatcacctccggg

SEQ ID NO: 90 - DNA, 20 bp, Artificial Sequence
  Antisense nucleotide
gttgtagatggaaatcacct

SEQ ID NO: 91 - DNA, 20 bp, Artificial Sequence
  Antisense nucleotide
ctggtactgttgtagatgga

SEQ ID NO: 92 - DNA, 20 bp, Artificial Sequence
  Antisense nucleotide
aggcggctgccctccggctt

SEQ ID NO: 93 - DNA, 20 bp, Artificial Sequence
  Antisense nucleotide
aacctccttggcgtagtact

SEQ ID NO: 94 - DNA, 20 bp, Artificial Sequence
  Antisense nucleotide
attttataaacctccttggc

SEQ ID NO: 95 - DNA, 20 bp, Artificial Sequence
  Antisense nucleotide
cggcatgtcgattttataaa

SEQ ID NO: 96 - DNA, 20 bp, Artificial Sequence
  Antisense nucleotide
cgggatggcattttcggagg

SEQ ID NO: 97 - DNA, 20 bp, Artificial Sequence
  Antisense nucleotide
gtagggtctgtagaaagtgg

SEQ ID NO: 98 - DNA, 20 bp, Artificial Sequence
  Antisense nucleotide
tgaagtagggtctgtagaaa

SEQ ID NO: 99 - DNA, 20 bp, Artificial Sequence
  Antisense nucleotide
attctgaagtagggtctgta

SEQ ID NO: 100 - DNA, 20 bp, Artificial Sequence
  Antisense nucleotide
aagcggacgattctgaagta

SEQ ID NO: 101 - DNA, 20 bp, Artificial Sequence
  Antisense nucleotide
cccaggttcctgtctttgtg

SEQ ID NO: 102 - DNA, 20 bp, Artificial Sequence
  Antisense nucleotide
ggcagtgtaaacttatttta

SEQ ID NO: 103 - DNA, 20 bp, Artificial Sequence
  Antisense nucleotide
ccatcaatacctgcaaatct

SEQ ID NO: 104 - DNA, 20 bp, Artificial Sequence
  Antisense nucleotide
aggtgccatcaatacctgca

SEQ ID NO: 105 - DNA, 20 bp, Artificial Sequence
  Antisense nucleotide
agttttctgatcaccactgg

SEQ ID NO: 106 - DNA, 20 bp, Artificial Sequence
  Antisense nucleotide
ttatagttttctgatcacca

SEQ ID NO: 107 - DNA, 20 bp, Artificial Sequence
  Antisense nucleotide
cctagtggactttatagttt

SEQ ID NO: 108 - DNA, 20 bp, Artificial Sequence
  Antisense nucleotide
acattagcaggagatgtggg

SEQ ID NO: 109 - DNA, 20 bp, Artificial
  Antisense nucleotide
agggcaacaacattagcagg

SEQ ID NO: 110 - DNA, 20 bp, Artificial Sequence
  Antisense nucleotide
actccagtctgtaggagggc

SEQ ID NO: 111 - DNA, 20 bp, Artificial Sequence
  Antisense nucleotide
tcctgcacatttctaaagca

SEQ ID NO: 112 - DNA, 20 bp, Artificial Sequence
  Antisense nucleotide
cagcaattatcctgcacatt

SEQ ID NO: 113 - DNA, 20 bp, Artificial Sequence
  Antisense nucleotide
atgtaaagagggcgaaggca

SEQ ID NO: 114 - DNA, 20 bp, Artificial Sequence
  Antisense nucleotide
ctcttaaaatcaatgtaaag

SEQ ID NO: 115 - DNA, 20 bp, Artificial Sequence
  Antisense nucleotide
ccaagatccctcttaaaatc

SEQ ID NO: 116 - DNA, 20 bp, Artificial Sequence
  Antisense nucleotide
cctttgggttcatggatcca

SEQ ID NO: 117 - DNA, 20 bp, Artificial Sequence
  Antisense nucleotide
gcattgtaccctttgggttc

SEQ ID NO: 118 - DNA, 20 bp, Artificial Sequence
  Antisense nucleotide
gcacagaagttagcattgta

SEQ ID NO: 119 - DNA, 20 bp, Artificial Sequence
  Antisense nucleotide
ctgaggactttggtgtgttg

SEQ ID NO: 120 - DNA, 20 bp, Artificial Sequence
  Antisense nucleotide
tcctgggacacacagcaagg

SEQ ID NO: 121 - DNA, 20 bp, Artificial Sequence
  Antisense nucleotide
tttagctgcatttacaagac

SEQ ID NO: 122 - DNA, 20 bp, Artificial Sequence
  Antisense nucleotide
caaggactttagctgcattt

SEQ ID NO: 123 - DNA, 20 bp, Artificial Sequence
  Antisense nucleotide
gtcattgtcaccgtgatttt

SEQ ID NO: 124 - DNA, 20 bp, Artificial Sequence
  Antisense nucleotide
ccagttttaacaaacagaac

SEQ ID NO: 125 - DNA, 20 bp, Artificial Sequence
  Antisense nucleotide
agatgccagttttaacaaac

SEQ ID NO: 126 - DNA, 20 bp, Artificial Sequence
  Antisense nucleotide
gttcattatatagtaacaca

SEQ ID NO: 127 - DNA, 20 bp, Artificial Sequence
  Antisense nucleotide
atgaaaggttcattatatag

SEQ ID NO: 128 - DNA, 20 bp, Artificial Sequence
  Antisense nucleotide
ttccaagggtaatgaaaggt

SEQ ID NO: 129 - DNA, 20 bp, Artificial Sequence
  Antisense nucleotide
cttaagccatccatgagttt

SEQ ID NO: 130 - DNA, 20 bp, Artificial Sequence
  Antisense nucleotide
cctggcttatttgagttcaa

SEQ ID NO: 131 - DNA, 20 bp, Artificial Sequence
  Antisense nucleotide
ttagtcctataacaactcac

SEQ ID NO: 132 - DNA, 20 bp, Artificial Sequence
  Antisense nucleotide
gcaaagaaccatttacaatt

SEQ ID NO: 133 - DNA, 20 bp, Artificial Sequence
  Antisense nucleotide
cttgcttaaactggcaaaga

SEQ ID NO: 134 - DNA, 20 bp, Artificial Sequence
  Antisense nucleotide
acatgtaaagtagttactgt

SEQ ID NO: 135 - DNA, 20 bp, Artificial Sequence
  Antisense nucleotide
acacattacatgtaaagtag

SEQ ID NO: 136 - DNA, 20 bp, Artificial Sequence
  Antisense nucleotide
taagatctacacattacatg

SEQ ID NO: 137 - DNA, 20 bp, Artificial Sequence
  Antisense nucleotide
attcaaaggtactggccagc

SEQ ID NO: 138 - DNA, 20 bp, Artificial Sequence
  Antisense nucleotide
tttgtagtgcaagtcaaaat

SEQ ID NO: 139 - DNA, 20 bp, Artificial Sequence
  Antisense nucleotide
catgtcattaaatggacaat

SEQ ID NO: 140 - DNA, 20 bp, Artificial Sequence
  Antisense nucleotide
cctacatttgtgcgaacttc

SEQ ID NO: 141 - DNA, 20 bp, Artificial Sequence
  Antisense nucleotide
ttccccctttgaaaaactca

SEQ ID NO: 142 - DNA, 20 bp, Artificial Sequence
  Antisense nucleotide
tttttaatcagcctgcaaag

SEQ ID NO: 143 - DNA, 20 bp, Artificial Sequence
  Antisense nucleotide
actgggcagacagtttcgga

SEQ ID NO: 144 - DNA, 20 bp, Artificial Sequence
  Antisense nucleotide
taacaactgggcagacagtt

SEQ ID NO: 145 - DNA, 20 bp, Artificial Sequence
  Antisense nucleotide
tgttgtaacaactgggcaga

SEQ ID NO: 146 - DNA, 20 bp, Artificial Sequence
  Antisense nucleotide
cacagagcacctgggactgt

SEQ ID NO: 147 - DNA, 20 bp, Artificial Sequence
  Antisense nucleotide
gtacccacagagcacctggg

SEQ ID NO: 148 - DNA, 20 bp, Artificial Sequence
  Antisense nucleotide
tcaaggtacccacagagcac

SEQ ID NO: 149 - DNA, 20 bp, Artificial Sequence
  Antisense nucleotide
tggcatcaaggtacccacag

SEQ ID NO: 150 - DNA, 20 bp, Artificial Sequence
  Antisense nucleotide
ggcgggatggcatcaaggta

SEQ ID NO: 151 - DNA, 20 bp, Artificial Sequence
  Antisense nucleotide
tttgcaggtattgatggcac

SEQ ID NO: 152 - DNA, 20 bp, Artificial Sequence
  Antisense nucleotide
ctccttcgatgtaactgatg

SEQ ID NO: 153 - DNA, 20 bp, Artificial Sequence
  Antisense nucleotide
ccttgctgcgtgtcccaaga

SEQ ID NO: 154 - DNA, 20 bp, Artificial Sequence
  Antisense nucleotide
tcgatatggaccagttcatg

SEQ ID NO: 155 - DNA, 20 bp, Artificial Sequence
  Antisense nucleotide
gtcccaagatttagaacctc

SEQ ID NO: 156 - DNA, 20 bp, Artificial Sequence
  Antisense nucleotide
gaacccaaaagccagagtgc

SEQ ID NO: 157 - DNA, 20 bp, Artificial Sequence
  Antisense nucleotide
atttcaagagggatctaggg

SEQ ID NO: 158 - DNA, 20 bp, Artificial Sequence
  Antisense nucleotide
aaacataagagagccttggt

SEQ ID NO: 159 - DNA, 20 bp, Artificial Sequence
  Antisense nucleotide
tctacctgcagcacactcga

SEQ ID NO: 160 - DNA, 20 bp, Artificial Sequence
  Antisense nucleotide
tcacaacagaccaaccggcg

SEQ ID NO: 161 - DNA, 20 bp, Artificial Sequence
  Antisense nucleotide
ttccaatttggtgaaagcag

SEQ ID NO: 162 - DNA, 20 bp, Artificial Sequence
  Antisense nucleotide
actctccttgatctatactt

SEQ ID NO: 163 - DNA, 20 bp, Artificial Sequence
  Antisense nucleotide
ccgcgggcagatcctgagca

SEQ ID NO: 164 - DNA, 20 bp, Artificial Sequence
  Antisense nucleotide
caaaatagacatgccgccct

SEQ ID NO: 165 - DNA, 20 bp, Artificial Sequence
  Antisense nucleotide
tgggatttaaaataagctta

SEQ ID NO: 166 - DNA, 20 bp, Artificial Sequence
  Antisense nucleotide
cagacttgagtcacaacaga

SEQ ID NO: 167 - DNA, 20 bp, Artificial Sequence
  Antisense nucleotide
ttggatgcggcctattgctt

SEQ ID NO: 168 - DNA, 20 bp, Artificial Sequence
  Antisense nucleotide
ctacgtccactttacattga

SEQ ID NO: 169 - DNA, 20 bp, Artificial Sequence
  Antisense nucleotide
ggaggtgatttccatctaca

SEQ ID NO: 170 - DNA, 20 bp, Artificial Sequence
  Antisense nucleotide
ccttggttcatcagtgttaa

SEQ ID NO: 171 - DNA, 20 bp, Artificial Sequence
  Antisense nucleotide
acgaacccaaagggtacaat

SEQ ID NO: 172 - DNA, 20 bp, Artificial Sequence
  Antisense nucleotide
attgatttcaagagggatct

SEQ ID NO: 173 - DNA, 20 bp, Artificial Sequence
  Antisense nucleotide
ctgcctacgtccactttaca

SEQ ID NO: 174 - DNA, 20 bp, Artificial Sequence
  Antisense nucleotide
caagagcagaaggcgaatgg

SEQ ID NO: 175 - DNA, 20 bp, Artificial Sequence
  Antisense nucleotide
tcaagtccaaagatttaaca

SEQ ID NO: 176 - DNA, 20 bp, Artificial Sequence
  Antisense nucleotide
aaatagacatgccgcccttc

SEQ ID NO: 177 - DNA, 20 bp, Artificial
  Antisense nucleotide
acactcagcacagcagggtc

SEQ ID NO: 178 - DNA, 20 bp, Artificial Sequence
  Antisense nucleotide
tgaaaaggcggtactagttc

SEQ ID NO: 179 - DNA, 20 bp, Artificial Sequence
  Antisense nucleotide
gttcatgcgcaagaggatcg

SEQ ID NO: 180 - DNA, 20 bp, Artificial Sequence
  Antisense nucleotide
atctcttcccttttggccgg

SEQ ID NO: 181 - DNA, 20 bp, Artificial Sequence
  Antisense nucleotide
taatagccactcgtctcttt

SEQ ID NO: 182 - DNA, 20 bp, Artificial Sequence
  Antisense nucleotide
ccgtattaatatttccactt

SEQ ID NO: 183 - DNA, 20 bp, Artificial Sequence
  Antisense nucleotide
caaacaactctccttgatct

SEQ ID NO: 184 - DNA, 20 bp, Artificial Sequence
  Antisense nucleotide
ctgtctgcccagttgttaca

SEQ ID NO: 185 - DNA, 20 bp, Artificial Sequence
  Antisense nucleotide
tgcccagttgttacaacacc

SEQ ID NO: 186 - DNA, 20 bp, Artificial Sequence
  Antisense nucleotide
tcccaggtgctctgtgggta

SEQ ID NO: 187 - DNA, 20 bp, Artificial Sequence
  Antisense nucleotide
gatgataatgatgatgacga

SEQ ID NO: 188 - DNA, 20 bp, Artificial Sequence
  Antisense nucleotide
gctatgcaataggcaccctt

SEQ ID NO: 189 - DNA, 20 bp, Artificial Sequence
  Antisense nucleotide
ctcttagagttaacagtgag

SEQ ID NO: 190 - DNA, 20 bp, Artificial Sequence
  Antisense nucleotide
gtggagaccaaatactttgc

SEQ ID NO: 191 - DNA, 20 bp, Artificial Sequence
  Antisense nucleotide
gaaagtctgcattaagataa

SEQ ID NO: 192 - DNA, 20 bp, Artificial Sequence
  Antisense nucleotide
ctaaggaagcttcttgtaag

SEQ ID NO: 193 - DNA, 20 bp, Artificial Sequence
  Antisense nucleotide
gcaagctgaagctcaccagt

SEQ ID NO: 194 - DNA, 20 bp, Artificial Sequence
  Antisense nucleotide
tagggtggaaatggatacac

SEQ ID NO: 195 - DNA, 20 bp, Artificial Sequence
  Antisense nucleotide
caatgccaacttctgtgctg

SEQ ID NO: 196 - DNA, 20 bp, Artificial Sequence
  Antisense nucleotide
aagcatctgcttctccttgc

SEQ ID NO: 197 - DNA, 20 bp, Artificial Sequence
  Antisense nucleotide
cagctaaaattcttggaaaa

SEQ ID NO: 198 - DNA, 20 bp, Artificial Sequence
  Antisense nucleotide
gatgatgcttgtaacaagaa

SEQ ID NO: 199 - DNA, 20 bp, Artificial Sequence
  Antisense nucleotide
aaactcctagctgtctgccc

SEQ ID NO: 200 - DNA, 20 bp, Artificial Sequence
  Antisense nucleotide
gggtaccttggtgagtacac

SEQ ID NO: 201 - DNA, 20 bp, Artificial Sequence
  Antisense nucleotide
cggcctcccaaagtgctggg

SEQ ID NO: 202 - DNA, 20 bp, Artificial Sequence
  Antisense nucleotide
tgggattacaggcgtgagcc

SEQ ID NO: 203 - DNA, 20 bp, Artificial Sequence
  Antisense nucleotide
tgtatagccatcaccactat

SEQ ID NO: 204 - DNA, 20 bp, Artificial Sequence
  Antisense nucleotide
acactgaactccatttcttc

SEQ ID NO: 205 - DNA, 20 bp, Artificial Sequence
  Antisense nucleotide
cctctcccttccaggagaaa

SEQ ID NO: 206 - DNA, 20 bp, Artificial Sequence
  Antisense nucleotide
gttgggaacgcgttgcattt

SEQ ID NO: 207 - DNA, 20 bp, Artificial Sequence
  Antisense nucleotide
ccgctctgagaattactagt

SEQ ID NO: 208 - DNA, 20 bp, Artificial Sequence
  Antisense nucleotide
ctgagaattactagtttctt

SEQ ID NO: 209 - DNA, 20 bp, Artificial Sequence
  Antisense nucleotide
tttaaaaacatgcactactg

SEQ ID NO: 210 - DNA, 20 bp, Artificial Sequence
  Antisense nucleotide
atgcactactgtgtgctgag

SEQ ID NO: 211 - DNA, 20 bp, Artificial Sequence
  Antisense nucleotide
gcgctcagtctgtctacctg

SEQ ID NO: 212 - DNA, 20 bp, Artificial Sequence
  Antisense nucleotide
atgcgcaagaggatcgaggc

SEQ ID NO: 213 - DNA, 20 bp, Artificial Sequence
  Antisense nucleotide
agaggatcgaggccatccgc

SEQ ID NO: 214 - DNA, 20 bp, Artificial Sequence
  Antisense nucleotide
atccgcgggcagatcctgag

SEQ ID NO: 215 - DNA, 20 bp, Artificial Sequence
  Antisense nucleotide
cccggaagactatccggagc

SEQ ID NO: 216 - DNA, 20 bp, Artificial Sequence
  Antisense nucleotide
cccggaggtgatttccatct

SEQ ID NO: 217 - DNA, 20 bp, Artificial Sequence
  Antisense nucleotide
aggtgatttccatctacaac

SEQ ID NO: 218 - DNA, 20 bp, Artificial Sequence
  Antisense nucleotide
tccatctacaacagtaccag

SEQ ID NO: 219 - DNA, 20 bp, Artificial Sequence
  Antisense nucleotide
aagccggagggcagccgcct

SEQ ID NO: 220 - DNA, 20 bp, Artificial Sequence
  Antisense nucleotide
agtactacgccaaggaggtt

SEQ ID NO: 221 - DNA, 20 bp, Artificial Sequence
  Antisense nucleotide
gccaaggaggtttataaaat

SEQ ID NO: 222 - DNA, 20 bp, Artificial Sequence
  Antisense nucleotide
tttataaaatcgacatgccg

SEQ ID NO: 223 - DNA, 20 bp, Artificial Sequence
  Antisense nucleotide
cctccgaaaatgccatcccg

SEQ ID NO: 224 - DNA, 20 bp, Artificial Sequence
  Antisense nucleotide
ccactttctacagaccctac

SEQ ID NO: 225 - DNA, 20 bp, Artificial Sequence
  Antisense nucleotide
tttctacagaccctacttca

SEQ ID NO: 226 - DNA, 20 bp, Artificial Sequence
  Antisense nucleotide
tacagaccctacttcagaat

SEQ ID NO: 227 - DNA, 20 bp, Artificial Sequence
  Antisense nucleotide
tacttcagaatcgtccgctt

SEQ ID NO: 228 - DNA, 20 bp, Artificial Sequence
  Antisense nucleotide
cacaaagacaggaacctggg

SEQ ID NO: 229 - DNA, 20 bp, Artificial Sequence
  Antisense nucleotide
taaaataagtttacactgcc

SEQ ID NO: 230 - DNA, 20 bp, Artificial Sequence
  Antisense nucleotide
tgcaggtattgatggcacct

SEQ ID NO: 231 - DNA, 20 bp, Artificial Sequence
  Antisense nucleotide
ccagtggtgatcagaaaact

SEQ ID NO: 232 - DNA, 20 bp, Artificial Sequence
  Antisense nucleotide
tggtgatcagaaaactataa

SEQ ID NO: 233 - DNA, 20 bp, Artificial Sequence
  Antisense nucleotide
cctgctaatgttgttgccct

SEQ ID NO: 234 - DNA, 20 bp, Artificial Sequence
  Antisense nucleotide
gccctcctacagactggagt

SEQ ID NO: 235 - DNA, 20 bp, Artificial Sequence
  Antisense nucleotide
tgctttagaaatgtgcagga

SEQ ID NO: 236 - DNA, 20 bp, Artificial Sequence
  Antisense nucleotide
tgccttcgccctctttacat

SEQ ID NO: 237 - DNA, 20 bp, Artificial Sequence
  Antisense nucleotide
gattttaagagggatcttgg

SEQ ID NO: 238 - DNA, 20 bp, Artificial Sequence
  Antisense nucleotide
tggatccatgaacccaaagg

SEQ ID NO: 239 - DNA, 20 bp, Artificial Sequence
  Antisense nucleotide
gaacccaaagggtacaatgc

SEQ ID NO: 240 - DNA, 20 bp, Artificial Sequence
  Antisense nucleotide
tacaatgctaacttctgtgc

SEQ ID NO: 241 - DNA, 20 bp, Artificial Sequence
  Antisense nucleotide
ccttgctgtgtgtcccagga

SEQ ID NO: 242 - DNA, 20 bp, Artificial Sequence
  Antisense nucleotide
gtcttgtaaatgcagctaaa

SEQ ID NO: 243 - DNA, 20 bp, Artificial Sequence
  Antisense nucleotide
aaatgcagctaaagtccttg

SEQ ID NO: 244 - DNA, 20 bp, Artificial Sequence
  Antisense nucleotide
aaaatcacggtgacaatgac

SEQ ID NO: 245 - DNA, 20 bp, Artificial Sequence
  Antisense nucleotide
gttctgtttgttaaaactgg

SEQ ID NO: 246 - DNA, 20 bp, Artificial Sequence
  Antisense nucleotide
gtttgttaaaactggcatct

SEQ ID NO: 247 - DNA, 20 bp, Artificial Sequence
  Antisense nucleotide
tgtgttactatataatgaac

SEQ ID NO: 248 - DNA, 20 bp, Artificial Sequence
  Antisense nucleotide
acctttcattacccttggaa

SEQ ID NO: 249 - DNA, 20 bp, Artificial Sequence
  Antisense nucleotide
aaactcatggatggcttaag

SEQ ID NO: 250 - DNA, 20 bp, Artificial Sequence
  Antisense nucleotide
aattgtaaatggttctttgc

SEQ ID NO: 251 - DNA, 20 bp, Artificial Sequence
  Antisense nucleotide
tctttgccagtttaagcaag

SEQ ID NO: 252 - DNA, 20 bp, Artificial Sequence
  Antisense nucleotide
acagtaactactttacatgt

SEQ ID NO: 253 - DNA, 20 bp, Artificial Sequence
  Antisense nucleotide
ctactttacatgtaatgtgt

SEQ ID NO: 254 - DNA, 20 bp, Artificial Sequence
  Antisense nucleotide
catgtaatgtgtagatctta

SEQ ID NO: 255 - DNA, 20 bp, Artificial Sequence
  Antisense nucleotide
gctggccagtacctttgaat

SEQ ID NO: 256 - DNA, 20 bp, Artificial
  Antisense nucleotide
ctttgcaggctgattaaaaa

SEQ ID NO: 257 - DNA, 20 bp, Artificial Sequence
  Antisense nucleotide
aactgtctgcccagttgtta

SEQ ID NO: 258 - DNA, 20 bp, Artificial Sequence
  Antisense nucleotide
tctgcccagttgttacaaca

SEQ ID NO: 259 - DNA, 20 bp, Artificial Sequence
  Antisense nucleotide
acagtcccaggtgctctgtg

SEQ ID NO: 260 - DNA, 20 bp, Artificial Sequence
  Antisense nucleotide
cccaggtgctctgtgggtac

SEQ ID NO: 261 - DNA, 20 bp, Artificial Sequence
  Antisense nucleotide
gtgctctgtgggtaccttga

SEQ ID NO: 262 - DNA, 20 bp, Artificial Sequence
  Antisense nucleotide
ctgtgggtaccttgatgcca

SEQ ID NO: 263 - DNA, 20 bp, Artificial Sequence
  Antisense nucleotide
taccttgatgccatcccgcc

SEQ ID NO: 264 - DNA, 20 bp, Artificial Sequence
  Antisense nucleotide
ttccaccattagcacgcggg

SEQ ID NO: 265 - DNA, 20 bp, Artificial Sequence
  Antisense nucleotide
ccgtgaccagatgcaggatc

SEQ ID NO: 266 - DNA, 21 bp, Artificial Sequence
  Antisense nucleotide
cccggagggcggcatggggga

SEQ ID NO: 267 - DNA, 18 bp, Artificial Sequence
  Antisense nucleotide
cctcagggagaagggcgc

SEQ ID NO: 268 - DNA, 18 bp, Artificial Sequence
  Antisense nucleotide
gtaggagggcctcgaggg

SEQ ID NO: 269 - DNA, 18 bp, Artificial Sequence
  Antisense nucleotide
ctgcaggggctgggggtc

SEQ ID NO: 270 - DNA, 18 bp, Artificial Sequence
  Antisense nucleotide
agggctggtgtggtgggg

SEQ ID NO: 271 - DNA, 18 bp, Artificial Sequence
  Antisense nucleotide
ggcatgggggaggcggcg

SEQ ID NO: 272 - DNA, 18 bp, Artificial Sequence
  Antisense nucleotide
ccggagggcggcatgggg

SEQ ID NO: 273 - DNA, 18 bp, Artificial Sequence
  Antisense nucleotide
ggggggctggcgagccgc

SEQ ID NO: 274 - DNA, 23 bp, Artificial Sequence
  Antisense nucleotide
ggacaggatctggccgcggatgg

SEQ ID NO: 275 - DNA, 18 bp, Artificial Sequence
  Antisense nucleotide
ccccctggctcggggggc

SEQ ID NO: 276 - DNA, 18 bp, Artificial Sequence
  Antisense nucleotide
gggccgggcggcacctcc

SEQ ID NO: 277 - DNA, 18 bp, Artificial Sequence
  Antisense nucleotide
gggcagcgggccgggcgg

SEQ ID NO: 278 - DNA, 18 bp, Artificial Sequence
  Antisense nucleotide
acggcctcgggcagcggg

SEQ ID NO: 279 - DNA, 18 bp, Artificial Sequence
  Antisense nucleotide
gggtgctgttgtacaggg

SEQ ID NO: 280 - DNA, 24 bp, Artificial Sequence
  Antisense nucleotide
gggtttccaccattagcacgcggg

SEQ ID NO: 281 - DNA, 14 bp, Artificial Sequence
  Antisense nucleotide
tcatagatttcgtt

SEQ ID NO: 282 - DNA, 13 bp, Artificial Sequence
  Antisense nucleotide
ttgtcatagattt

SEQ ID NO: 283 - DNA, 15 bp, Artificial Sequence
  Antisense nucleotide
aagaacatatatatg

SEQ ID NO: 284 - DNA, 14 bp, Artificial Sequence
  Antisense nucleotide
aagaacatatatat

SEQ ID NO: 285 - DNA, 16 bp, Artificial Sequence
  Antisense nucleotide
ttgaagaacatatata

SEQ ID NO: 286 - DNA, 18 bp, Artificial Sequence
  Antisense nucleotide
ccgggagagcaacacggg

SEQ ID NO: 287 - DNA, 13 bp, Artificial
  Antisense nucleotide
acttttaacttga

SEQ ID NO: 288 - DNA, 15 bp, Artificial Sequence
  Antisense nucleotide
attgttgctgtattt

SEQ ID NO: 289 - DNA, 14 bp, Artificial Sequence
  Antisense nucleotide
attgttgctgtatt

SEQ ID NO: 290 - DNA, 15 bp, Artificial Sequence
  Antisense nucleotide
aattgttgctgtatt

SEQ ID NO: 291 - DNA, 14 bp, Artificial Sequence
  Antisense nucleotide
aattgttgctgtat

SEQ ID NO: 292 - DNA, 27 bp, Artificial Sequence
  Antisense nucleotide
ggcgagtcgctgggtgccagcagccgg

SEQ ID NO: 293 - DNA, 14 bp, Artificial Sequence
  Antisense nucleotide
ggcgagtcgctggg

SEQ ID NO: 294 - DNA, 14 bp, Artificial Sequence
  Antisense nucleotide
acatcaaaagataa

SEQ ID NO: 295 - DNA, 14 bp, Artificial Sequence
  Antisense nucleotide
tgacatcaaaagat

SEQ ID NO: 296 - DNA, 18 bp, Artificial Sequence
  Antisense nucleotide
gggccctctccagcgggg

SEQ ID NO: 297 - DNA, 18 bp, Artificial Sequence
  Antisense nucleotide
gggctcggcggtgccggg

SEQ ID NO: 298 - DNA, 18 bp, Artificial Sequence
  Antisense nucleotide
ggggcagggcccgaggca

SEQ ID NO: 299 - DNA, 18 bp, Artificial Sequence
  Antisense nucleotide
ggctccaaatgtaggggc

SEQ ID NO: 300 - DNA, 24 bp, Artificial Sequence
  Antisense nucleotide
cgggttatgctggttgtacagggc

SEQ ID NO: 301 - DNA, 22 bp, Artificial Sequence
  Antisense nucleotide
cggcgccgccgaggcgcccggg

SEQ ID NO: 302 - DNA, 16 bp, Artificial Sequence
  Antisense nucleotide
ggggcggggcgggacc

SEQ ID NO: 303 - DNA, 18 bp, Artificial Sequence
  Antisense nucleotide
gggcggggcggggcgggg

SEQ ID NO: 304 - DNA, 18 bp, Artificial Sequence
  Antisense nucleotide
gggcggggtggggccggg

SEQ ID NO: 305 - DNA, 22 bp, Artificial Sequence
  Antisense nucleotide
gggcaaggcagcgggggcgggg

SEQ ID NO: 306 - DNA, 14 bp, Artificial
  Antisense nucleotide
cggtagcagcagcg

SEQ ID NO: 307 - DNA, 14 bp, Artificial Sequence
  Antisense nucleotide
ccagtagccacagc

SEQ ID NO: 308 - DNA, 15 bp, Artificial Sequence
  Antisense nucleotide
gcaggtggatagtcc

SEQ ID NO: 309 - DNA, 15 bp, Artificial Sequence
  Antisense nucleotide
cttgcaggtggatag

SEQ ID NO: 310 - DNA, 15 bp, Artificial Sequence
  Antisense nucleotide
cgatagtcttgcagg

SEQ ID NO: 311 - DNA, 18 bp, Artificial Sequence
  Antisense nucleotide
ccatgtcgatagtcttgc

SEQ ID NO: 312 - DNA, 15 bp, Artificial Sequence
  Antisense nucleotide
ctcgatgcgcttccg

SEQ ID NO: 313 - DNA, 15 bp, Artificial Sequence
  Antisense nucleotide
cctcgatgcgcttcc

SEQ ID NO: 314 - DNA, 15 bp, Artificial Sequence
  Antisense nucleotide
ggatggcctcgatgc

SEQ ID NO: 315 - DNA, 15 bp, Artificial Sequence
  Antisense nucleotide
ggacaggatctggcc

SEQ ID NO: 316 - DNA, 15 bp, Artificial Sequence
  Antisense nucleotide
cgcagcttggacagg

SEQ ID NO: 317 - DNA, 14 bp, Artificial Sequence
  Antisense nucleotide
gagccgcagcttgg

SEQ ID NO: 318 - DNA, 14 bp, Artificial Sequence
  Antisense nucleotide
cgagccgcagcttg

SEQ ID NO: 319 - DNA, 14 bp, Artificial Sequence
  Antisense nucleotide
acctccccctggct

SEQ ID NO: 320 - DNA, 14 bp, Artificial Sequence
  Antisense nucleotide
ccaccattagcacg

SEQ ID NO: 321 - DNA, 18 bp, Artificial Sequence
  Antisense nucleotide
gaacttgtcatagatttc

SEQ ID NO: 322 - DNA, 16 bp, Artificial Sequence
  Antisense nucleotide
gctgtgtgtactctgc

SEQ ID NO: 323 - DNA, 14 bp, Artificial Sequence
  Antisense nucleotide
gctccacgtgctgc

SEQ ID NO: 324 - DNA, 18 bp, Artificial Sequence
  Antisense nucleotide
gaattgttgctgtatttc

SEQ ID NO: 325 - DNA, 15 bp, Artificial Sequence
  Antisense nucleotide
gccaggaattgttgc

SEQ ID NO: 326 - DNA, 18 bp, Artificial Sequence
  Antisense nucleotide
gtgacatcaaaagataac

SEQ ID NO: 327 - DNA, 15 bp, Artificial Sequence
  Antisense nucleotide
ggctcaaccactgcc

SEQ ID NO: 328 - DNA, 14 bp, Artificial Sequence
  Antisense nucleotide
gctgtcacaggagc

SEQ ID NO: 329 - DNA, 14 bp, Artificial Sequence
  Antisense nucleotide
cctgctgtcacagg

SEQ ID NO: 330 - DNA, 18 bp, Artificial Sequence
  Antisense nucleotide
gcagtgtgttatccctgc

SEQ ID NO: 331 - DNA, 15 bp, Artificial Sequence
  Antisense nucleotide
gcagtgtgttatccc

SEQ ID NO: 332 - DNA, 14 bp, Artificial Sequence
  Antisense nucleotide
ccaggtcacctcgg

SEQ ID NO: 333 - DNA, 15 bp, Artificial Sequence
  Antisense nucleotide
gccatgaatggtggc

SEQ ID NO: 334 - DNA, 14 bp, Artificial Sequence
  Antisense nucleotide
gccatgaatggtgg

SEQ ID NO: 335 - DNA, 14 bp, Artificial Sequence
  Antisense nucleotide
ccatgagaagcagg

SEQ ID NO: 336 - DNA, 17 bp, Artificial Sequence
  Antisense nucleotide
ggaagtcaatgtacagc

SEQ ID NO: 337 - DNA, 18 bp, Artificial Sequence
  Antisense nucleotide
ccacgtagtacacgatgg

SEQ ID NO: 338 - DNA, 14 bp, Artificial Sequence
  Antisense nucleotide
gcacttgcaggagc

SEQ ID NO: 339 - DNA, 14 bp, Artificial Sequence
  Antisense nucleotide
ccatggcagtgacc

SEQ ID NO: 340 - DNA, 14 bp, Artificial Sequence
  Antisense nucleotide
ggctcctccatggc

SEQ ID NO: 341 - DNA, 16 bp, Artificial
  Antisense nucleotide
gctaggatctgactgc

SEQ ID NO: 342 - DNA, 14 bp, Artificial Sequence
  Antisense nucleotide
cctgactcagaggg

SEQ ID NO: 343 - DNA, 17 bp, Artificial Sequence
  Antisense nucleotide
ggtctgaaaatgtttcc

SEQ ID NO: 344 - DNA, 16 bp, Artificial Sequence
  Antisense nucleotide
ccattgcttgggacgg

SEQ ID NO: 345 - DNA, 14 bp, Artificial Sequence
  Antisense nucleotide
gcatcaaatcatcc

SEQ ID NO: 346 - DNA, 16 bp, Artificial Sequence
  Antisense nucleotide
ccattgttcaatatcg

SEQ ID NO: 347 - DNA, 15 bp, Artificial Sequence
  Antisense nucleotide
ggtcttcagtgaacc

SEQ ID NO: 348 - DNA, 17 bp, Artificial Sequence
  Antisense nucleotide
ggagcttcatctggacc

SEQ ID NO: 349 - DNA, 15 bp, Artificial Sequence
  Antisense nucleotide
cctctggcattctgg

SEQ ID NO: 350 - DNA, 14 bp, Artificial Sequence
  Antisense nucleotide
agggacagaagatg

SEQ ID NO: 351 - DNA, 14 bp, Artificial Sequence
  Antisense nucleotide
gttttctgggaagg

SEQ ID NO: 352 - DNA, 14 bp, Artificial Sequence
  Antisense nucleotide
ggttttctgggaag

SEQ ID NO: 353 - DNA, 15 bp, Artificial Sequence
  Antisense nucleotide
aggttttctgggaag

SEQ ID NO: 354 - DNA, 14 bp, Artificial Sequence
  Antisense nucleotide
gtaggttttctggg

SEQ ID NO: 355 - DNA, 14 bp, Artificial Sequence
  Antisense nucleotide
ggtaggttttctgg

SEQ ID NO: 356 - DNA, 17 bp, Artificial Sequence
  Antisense nucleotide
ccagaatgcaagaagcc

SEQ ID NO: 357 - DNA, 15 bp, Artificial Sequence
  Antisense nucleotide
gctgtcccagaatgc

SEQ ID NO: 358 - DNA, 18 bp, Artificial Sequence
  Antisense nucleotide
gcaagtcacagacttggc

SEQ ID NO: 359 - DNA, 15 bp, Artificial Sequence
  Antisense nucleotide
ccacagctgcacagg

SEQ ID NO: 360 - DNA, 15 bp, Artificial Sequence
  Antisense nucleotide
ggtgtggaatcaacc

SEQ ID NO: 361 - DNA, 14 bp, Artificial Sequence
  Antisense nucleotide
gtcatgtgctgtga

SEQ ID NO: 362 - DNA, 16 bp, Artificial Sequence
  Antisense nucleotide
cgctatctgagcagcg

SEQ ID NO: 363 - DNA, 15 bp, Artificial Sequence
  Antisense nucleotide
ccagtgtgatgatgg

SEQ ID NO: 364 - DNA, 18 bp, Artificial Sequence
  Antisense nucleotide
ccagtagattaccactgg

SEQ ID NO: 365 - DNA, 16 bp, Artificial Sequence
  Antisense nucleotide
ggcacaaacacgcacc

SEQ ID NO: 366 - DNA, 15 bp, Artificial Sequence
  Antisense nucleotide
ccacggatctgaagg

SEQ ID NO: 367 - DNA, 17 bp, Artificial Sequence
  Antisense nucleotide
cggaacatctcgaagcg

SEQ ID NO: 368 - DNA, 17 bp, Artificial Sequence
  Antisense nucleotide
cctcattcagctctcgg

SEQ ID NO: 369 - DNA, 15 bp, Artificial Sequence
  Antisense nucleotide
ccttgagttccaagg

SEQ ID NO: 370 - DNA, 17 bp, Artificial Sequence
  Antisense nucleotide
cctttttggacttcagg

SEQ ID NO: 371 - DNA, 16 bp, Artificial
  Antisense nucleotide
ggaggtagactgaccc

SEQ ID NO: 372 - DNA, 12 bp, Artificial Sequence
  Antisense nucleotide
aaaatgtttcct

SEQ ID NO: 373 - DNA, 12 bp, Artificial Sequence
  Antisense nucleotide
tgaaaatgtttc

SEQ ID NO: 374 - DNA, 12 bp, Artificial Sequence
  Antisense nucleotide
ctgaaaatgttt

SEQ ID NO: 375 - DNA, 13 bp, Artificial Sequence
  Antisense nucleotide
tctgaaaatgttt

SEQ ID NO: 376 - DNA, 12 bp, Artificial Sequence
  Antisense nucleotide
tctgaaaatgtt

SEQ ID NO: 377 - DNA, 12 bp, Artificial Sequence
  Antisense nucleotide
aaatcatccatt

SEQ ID NO: 378 - DNA, 12 bp, Artificial Sequence
  Antisense nucleotide
ttgttcaatatc

SEQ ID NO: 379 - DNA, 13 bp, Artificial Sequence
  Antisense nucleotide
attgttcaatatc

SEQ ID NO: 380 - DNA, 12 bp, Artificial Sequence
  Antisense nucleotide
attgttcaatat

SEQ ID NO: 381 - DNA, 13 bp, Artificial Sequence
  Antisense nucleotide
cattgttcaatat

SEQ ID NO: 382 - DNA, 12 bp, Artificial Sequence
  Antisense nucleotide
cattgttcaata

SEQ ID NO: 383 - DNA, 12 bp, Artificial Sequence
  Antisense nucleotide
aaaagtgtttct

SEQ ID NO: 384 - DNA, 15 bp, Artificial Sequence
  Antisense nucleotide
acatgagttttttat

SEQ ID NO: 385 - DNA, 16 bp, Artificial Sequence
  Antisense nucleotide
aacatgagttttttat

SEQ ID NO: 386 - DNA, 14 bp, Artificial Sequence
  Antisense nucleotide
acatgagtttttta

SEQ ID NO: 387 - DNA, 15 bp, Artificial Sequence
  Antisense nucleotide
aacatgagtttttta

SEQ ID NO: 388 - DNA, 14 bp, Artificial
  Antisense nucleotide
aacatgagtttttt

SEQ ID NO: 389 - DNA, 13 bp, Artificial Sequence
  Antisense nucleotide
aaaacatcttgtt

SEQ ID NO: 390 - DNA, 17 bp, Artificial Sequence
  Antisense nucleotide
cagagggggctcgacgc

SEQ ID NO: 391 - DNA, 18 bp, Artificial
  Antisense nucleotide
ctgactcagagggggctc

SEQ ID NO: 392 - DNA, 14 bp, Artificial Sequence
  Antisense nucleotide
agggggacagaacg

SEQ ID NO: 393 - DNA, 23 bp, Artificial Sequence
  Antisense nucleotide
ttgggacggcaagggggacagaa

SEQ ID NO: 394 - DNA, 17 bp, Artificial Sequence
  Antisense nucleotide
tgggacggcaaggggga

SEQ ID NO: 395 - DNA, 15 bp, Artificial Sequence
  Antisense nucleotide
gccacggggggagca

SEQ ID NO: 396 - DNA, 19 bp, Artificial Sequence
  Antisense nucleotide
gcaggggccacggggggag

SEQ ID NO: 397 - DNA, 14 bp, Artificial Sequence
  Antisense nucleotide
aggggccacggggg

SEQ ID NO: 398 - DNA, 14 bp, Artificial Sequence
  Antisense nucleotide
caggggccacgggg

SEQ ID NO: 399 - DNA, 15 bp, Artificial Sequence
  Antisense nucleotide
ggtgcaggggccacg

SEQ ID NO: 400 - DNA, 18 bp, Artificial Sequence
  Antisense nucleotide
tggtgcaggggccgccgg

SEQ ID NO: 401 - DNA, 18 bp, Artificial Sequence
  Antisense nucleotide
ggggctggtgcaggggcc

SEQ ID NO: 402 - DNA, 18 bp, Artificial Sequence
  Antisense Nucleotide
agggggctggtgcagggg

SEQ ID NO: 403 - DNA, 14 bp, Artificial Sequence
  Antisense nucleotide
gggctggtgcaggg

SEQ ID NO: 404 - DNA, 16 bp, Artificial Sequence
  Antisense nucleotide
gagggggctggtgcag

SEQ ID NO: 405 - DNA, 15 bp, Artificial Sequence
  Antisense nucleotide
aggagggggctggtg

SEQ ID NO: 406 - DNA, 18 bp, Artificial Sequence
  Antisense nucleotide
gggccaggagggggctgg

SEQ ID NO: 407 - DNA, 18 bp, Artificial Sequence
  Antisense nucleotide
aggggccaggagggggct

SEQ ID NO: 408 - DNA, 14 bp, Artificial Sequence
  Antisense nucleotide
ggggccaggagggg

SEQ ID NO: 409 - DNA, 15 bp, Artificial Sequence
  Antisense nucleotide
caggggccaggaggg

SEQ ID NO: 410 - DNA, 16 bp, Artificial Sequence
  Antisense nucleotide
tctgggaagggacaga

SEQ ID NO: 411 - DNA, 16 bp, Artificial Sequence
  Antisense nucleotide
tgagggcaggggagta

SEQ ID NO: 412 - DNA, 15 bp, Artificial Sequence
  Antisense nucleotide
ttgagggcaggggag

SEQ ID NO: 413 - DNA, 19 bp, Artificial Sequence
  Antisense nucleotide
cgggtgccgggcgggggtg

SEQ ID NO: 414 - DNA, 24 bp, Artificial Sequence
  Antisense nucleotide
cggacgcgggtgccgggcgggggt

SEQ ID NO: 415 - DNA, 15 bp, Artificial Sequence
  Antisense nucleotide
cgggtgccgggcggg

SEQ ID NO: 416 - DNA, 18 bp, Artificial Sequence
  Antisense nucleotide
ggacgcgggtgccgggcg

SEQ ID NO: 417 - DNA, 18 bp, Artificial Sequence
  Antisense nucleotide
tgggggcagcgcctcaca

SEQ ID NO: 418 - DNA, 16 bp, Artificial Sequence
  Antisense nucleotide
ggtgggggcagcgcct

SEQ ID NO: 419 - DNA, 20 bp, Artificial Sequence
  Antisense nucleotide
ccattttagtgcacatccgg

SEQ ID NO: 420 - DNA, 18 bp, Artificial Sequence
  Antisense nucleotide
ccattttagtgcacatcc

SEQ ID NO: 421 - DNA, 18 bp, Artificial Sequence
  Antisense nucleotide
gctgttccattttagtgc

SEQ ID NO: 422 - DNA, 14 bp, Artificial Sequence
  Antisense nucleotide
gtagtcgtgtagag

SEQ ID NO: 423 - DNA, 16 bp, Artificial Sequence
  Antisense nucleotide
gtttgtagtcgtgtag

SEQ ID NO: 424 - DNA, 17 bp, Artificial Sequence
  Antisense nucleotide
gtttcaggagtttgtag

SEQ ID NO: 425 - DNA, 15 bp, Artificial Sequence
  Antisense nucleotide
ccagctccgaagagg

SEQ ID NO: 426 - DNA, 16 bp, Artificial Sequence
  Antisense nucleotide
cgtcgtcgtgatcacg

SEQ ID NO: 427 - DNA, 16 bp, Artificial Sequence
  Antisense nucleotide
ggtaaaagtactgtcc

SEQ ID NO: 428 - DNA, 15 bp, Artificial Sequence
  Antisense nucleotide
ggctttgacaaagcc

SEQ ID NO: 429 - DNA, 18 bp, Artificial Sequence
  Antisense nucleotide
cttgtgcagatcgtccag

SEQ ID NO: 430 - DNA, 17 bp, Artificial Sequence
  Antisense nucleotide
cgtggttcatcttgtgc

SEQ ID NO: 431 - DNA, 18 bp, Artificial Sequence
  Antisense nucleotide
cacgtggttcatcttgtg

SEQ ID NO: 432 - DNA, 15 bp, Artificial Sequence
  Antisense nucleotide
cctccttgaaggtgg

SEQ ID NO: 433 - DNA, 17 bp, Artificial Sequence
  Antisense nucleotide
cgctccactttgatgcg

SEQ ID NO: 434 - DNA, 14 bp, Artificial Sequence
  Antisense nucleotide
ccttgtcctccagg

SEQ ID NO: 435 - DNA, 14 bp, Artificial Sequence
  Antisense nucleotide
ggtactcgacagcc

SEQ ID NO: 436 - DNA, 15 bp, Artificial Sequence
  Antisense nucleotide
ctgacgtgggtcatg

SEQ ID NO: 437 - DNA, 15 bp, Artificial Sequence
  Antisense nucleotide
ccgttgctgacgtgg

SEQ ID NO: 438 - DNA, 14 bp, Artificial Sequence
  Antisense nucleotide
catcctccgcctcc

SEQ ID NO: 439 - DNA, 14 bp, Artificial Sequence
  Antisense nucleotide
gtttccatcctccg

SEQ ID NO: 440 - DNA, 16 bp, Artificial Sequence
  Antisense nucleotide
ggtgtttccatcctcc

SEQ ID NO: 441 - DNA, 15 bp, Artificial Sequence
  Antisense nucleotide
ggtgtttccatcctc

SEQ ID NO: 442 - DNA, 15 bp, Artificial Sequence
  Antisense nucleotide
gctcagcgcctcatc

SEQ ID NO: 443 - DNA, 18 bp, Artificial Sequence
  Antisense nucleotide
ccttcttcatcatgctgc

SEQ ID NO: 444 - DNA, 17 bp, Artificial Sequence
  Antisense nucleotide
ccttcttcatcatgctg

SEQ ID NO: 445 - DNA, 15 bp, Artificial Sequence
  Antisense nucleotide
ccttcttcatcatgc

SEQ ID NO: 446 - DNA, 19 bp, Artificial Sequence
  Antisense nucleotide
gcgtccttcttcatcatgc

SEQ ID NO: 447 - DNA, 14 bp, Artificial Sequence
  Antisense nucleotide
cctgctcactcagg

SEQ ID NO: 448 - DNA, 14 bp, Artificial Sequence
  Antisense nucleotide
cgcaggcttgagcg

SEQ ID NO: 449 - DNA, 15 bp, Artificial Sequence
  Antisense nucleotide
gccagcttcagcagc

SEQ ID NO: 450 - DNA, 14 bp, Artificial Sequence
  Antisense nucleotide
ggtggtgaccagcc

SEQ ID NO: 451 - DNA, 14 bp, Artificial Sequence
  Antisense nucleotide
cctcggcgaactcc

SEQ ID NO: 452 - DNA, 14 bp, Artificial Sequence
  Antisense nucleotide
gcttgtgtaaatcc

SEQ ID NO: 453 - DNA, 20 bp, Artificial Sequence
  Antisense nucleotide
ggttctgcttgtgtaaatcc

SEQ ID NO: 454 - DNA, 15 bp, Artificial Sequence
  Antisense nucleotide
gctgctcaggttcgc

SEQ ID NO: 455 - DNA, 14 bp, Artificial Sequence
  Antisense nucleotide
gaaggcgaccgtcg

SEQ ID NO: 456 - DNA, 14 bp, Artificial Sequence
  Antisense nucleotide
cgaaggcgaccgtc

SEQ ID NO: 457 - DNA, 14 bp, Artificial Sequence
  Antisense nucleotide
gcaccgtctgtggc

SEQ ID NO: 458 - DNA, 17 bp, Artificial Sequence
  Antisense nucleotide
cgtgtccatgtcgatgg

SEQ ID NO: 459 - DNA, 16 bp, Artificial Sequence
  Antisense nucleotide
cgtgtccatgtcgatg

SEQ ID NO: 460 - DNA, 14 bp, Artificial Sequence
  Antisense nucleotide
gcgtgtccatgtcg

SEQ ID NO: 461 - DNA, 15 bp, Artificial Sequence
  Antisense nucleotide
ccagcttgcgcttgc

SEQ ID NO: 462 - DNA, 14 bp, Artificial Sequence
  Antisense nucleotide
cgctccagcttgcg

SEQ ID NO: 463 - DNA, 18 bp, Artificial Sequence
  Antisense nucleotide
cgtgttctgactcttgag

SEQ ID NO: 464 - DNA, 16 bp, Artificial Sequence
  Antisense nucleotide
cgtgttctgactcttg

SEQ ID NO: 465 - DNA, 14 bp, Artificial Sequence
  Antisense nucleotide
gctgttgacgtggc

SEQ ID NO: 466 - DNA, 14 bp, Artificial Sequence
  Antisense nucleotide
cgactcagtacgcc

SEQ ID NO: 467 - DNA, 14 bp, Artificial Sequence
  Antisense nucleotide
gccatgcccgactc

SEQ ID NO: 468 - DNA, 14 bp, Artificial Sequence
  Antisense nucleotide
cccttggaggtggc

SEQ ID NO: 469 - DNA, 13 bp, Artificial Sequence
  Antisense nucleotide
ttttagtgcacat

SEQ ID NO: 470 - DNA, 14 bp, Artificial Sequence
  Antisense nucleotide
tgttccattttagt

SEQ ID NO: 471 - DNA, 14 bp, Artificial Sequence
  Antisense nucleotide
aaaaaaagtggaag

SEQ ID NO: 472 - DNA, 14 bp, Artificial Sequence
  Antisense nucleotide
tacaaaaaaaagtg

SEQ ID NO: 473 - DNA, 14 bp, Artificial Sequence
  Antisense nucleotide
atacaaaaaaaagt

SEQ ID NO: 474 - DNA, 15 bp, Artificial Sequence
  Antisense nucleotide
catacaaaaaaaagt

SEQ ID NO: 475 - DNA, 14 bp, Artificial Sequence
  Antisense nucleotide
catacaaaaaaaag

SEQ ID NO: 476 - DNA, 14 bp, Artificial Sequence
  Antisense nucleotide
gaaaaaaaacatac

SEQ ID NO: 477 - DNA, 16 bp, Artificial Sequence
  Antisense nucleotide
cagaaaaaaaacatac

SEQ ID NO: 478 - DNA, 14 bp, Artificial Sequence
  Antisense nucleotide
cagaaaaaaaacat

SEQ ID NO: 479 - DNA, 14 bp, Artificial Sequence
  Antisense nucleotide
ttcaatatgaatcg

SEQ ID NO: 480 - DNA, 16 bp, Artificial Sequence
  Antisense nucleotide
tattcaatatgaatcg

SEQ ID NO: 481 - DNA, 15 bp, Artificial Sequence
  Antisense nucleotide
tattcaatatgaatc

SEQ ID NO: 482 - DNA, 14 bp, Artificial Sequence
  Antisense nucleotide
tattcaatatgaat

SEQ ID NO: 483 - DNA, 15 bp, Artificial Sequence
  Antisense nucleotide
tatattcaatatgaa

SEQ ID NO: 484 - DNA, 15 bp, Artificial
  Antisense nucleotide
ttatattcaatatga

SEQ ID NO: 485 - DNA, 17 bp, Artificial Sequence
  Antisense nucleotide
tattatattcaatatga

SEQ ID NO: 486 - DNA, 14 bp, Artificial Sequence
  Antisense nucleotide
ttatattcaatatg

SEQ ID NO: 487 - DNA, 16 bp, Artificial Sequence
  Antisense nucleotide
tattatattcaatatg

SEQ ID NO: 488 - DNA, 14 bp, Artificial Sequence
  Antisense nucleotide
attatattcaatat

SEQ ID NO: 489 - DNA, 15 bp, Artificial Sequence
  Antisense nucleotide
tattatattcaatat

SEQ ID NO: 490 - DNA, 18 bp, Artificial Sequence
  Antisense nucleotide
atatattatattcaatat

SEQ ID NO: 491 - DNA, 20 bp, Artificial Sequence
  Antisense nucleotide
aaatatattatattcaatat

SEQ ID NO: 492 - DNA, 14 bp, Artificial Sequence
  Antisense nucleotide
tattatattcaata

SEQ ID NO: 493 - DNA, 17 bp, Artificial Sequence
  Antisense nucleotide
atatattatattcaata

SEQ ID NO: 494 - DNA, 20 bp, Artificial Sequence
  Antisense nucleotide
caaatatattatattcaata

SEQ ID NO: 495 - DNA, 15 bp, Artificial Sequence
  Antisense nucleotide
tatattatattcaat

SEQ ID NO: 496 - DNA, 17 bp, Artificial Sequence
  Antisense nucleotide
aatatattatattcaat

SEQ ID NO: 497 - DNA, 14 bp, Artificial Sequence
  Antisense nucleotide
tatattatattcaa

SEQ ID NO: 498 - DNA, 18 bp, Artificial Sequence
  Antisense nucleotide
caaatatattatattcaa

SEQ ID NO: 499 - DNA, 17 bp, Artificial Sequence
  Antisense nucleotide
caaatatattatattca

SEQ ID NO: 500 - DNA, 16 bp, Artificial Sequence
  Antisense nucleotide
caaatatattatattc

SEQ ID NO: 501 - DNA, 18 bp, Artificial Sequence
  Antisense nucleotide
cacaaatatattatattc

SEQ ID NO: 502 - DNA, 14 bp, Artificial Sequence
  Antisense nucleotide
aaatatattatatt

SEQ ID NO: 503 - DNA, 15 bp, Artificial Sequence
  Antisense nucleotide
caaatatattatatt

SEQ ID NO: 504 - DNA, 14 bp, Artificial Sequence
  Antisense nucleotide
caaatatattatat

SEQ ID NO: 505 - DNA, 16 bp, Artificial Sequence
  Antisense nucleotide
cacaaatatattatat

SEQ ID NO: 506 - DNA, 14 bp, Artificial Sequence
  Antisense nucleotide
cacaaatatattat

SEQ ID NO: 507 - DNA, 16 bp, Artificial Sequence
  Antisense nucleotide
tacacaaatatattat

SEQ ID NO: 508 - DNA, 15 bp, Artificial Sequence
  Antisense nucleotide
tacacaaatatatta

SEQ ID NO: 509 - DNA, 18 bp, Artificial Sequence
  Antisense nucleotide
taaatacacaaatatatt

SEQ ID NO: 510 - DNA, 14 bp, Artificial Sequence
  Antisense nucleotide
aatacacaaatata

SEQ ID NO: 511 - DNA, 16 bp, Artificial Sequence
  Antisense nucleotide
gttaaatacacaaata

SEQ ID NO: 512 - DNA, 14 bp, Artificial Sequence
  Antisense nucleotide
tgttaaatacacaa

SEQ ID NO: 513 - DNA, 14 bp, Artificial Sequence
  Antisense nucleotide
tttagagactaagt

SEQ ID NO: 514 - DNA, 14 bp, Artificial Sequence
  Antisense nucleotide
ataaactctttaga

SEQ ID NO: 515 - DNA, 17 bp, Artificial Sequence
  Antisense nucleotide
taaaataaactctttag

SEQ ID NO: 516 - DNA, 16 bp, Artificial Sequence
  Antisense nucleotide
taaaataaactcttta

SEQ ID NO: 517 - DNA, 16 bp, Artificial Sequence
  Antisense nucleotide
ttaaaataaactcttt

SEQ ID NO: 518 - DNA, 14 bp, Artificial Sequence
  Antisense nucleotide
cttaaaataaactc

SEQ ID NO: 519 - DNA, 15 bp, Artificial Sequence
  Antisense nucleotide
taaaaagaacaaaca

SEQ ID NO: 520 - DNA, 14 bp, Artificial Sequence
  Antisense nucleotide
taaaaagaacaaac

SEQ ID NO: 521 - DNA, 15 bp, Artificial Sequence
  Antisense nucleotide
caataaaaagaacaa

SEQ ID NO: 522 - DNA, 16 bp, Artificial Sequence
  Antisense nucleotide
tcaataaaaagaacaa

SEQ ID NO: 523 - DNA, 14 bp, Artificial Sequence
  Antisense nucleotide
tcaataaaaagaac

SEQ ID NO: 524 - DNA, 14 bp, Artificial Sequence
  Antisense nucleotide
ttcaataaaaagaa

SEQ ID NO: 525 - DNA, 17 bp, Artificial Sequence
  Antisense nucleotide
tagattcaataaaaaga

SEQ ID NO: 526 - DNA, 17 bp, Artificial Sequence
  Antisense nucleotide
tggcgcgggcgggtagc

SEQ ID NO: 527 - DNA, 20 bp, Artificial Sequence
  Antisense nucleotide
gggctggcgcgggcgggtag

SEQ ID NO: 528 - DNA, 21 bp, Artificial Sequence
  Antisense nucleotide
tcgggggctggcgcgggcggg

SEQ ID NO: 529 - DNA, 26 bp, Artificial Sequence
  Antisense nucleotide
tgggtgcctggtcgcgcgttctcggg

SEQ ID NO: 530 - DNA, 18 bp, Artificial Sequence
  Antisense nucleotide
agggtccctgcggggccg

SEQ ID NO: 531 - DNA, 18 bp, Artificial Sequence
  Antisense nucleotide
gggagggtccctgcgggg

SEQ ID NO: 532 - DNA, 16 bp, Artificial Sequence
  Antisense nucleotide
gggagggtccctgcgg

SEQ ID NO: 533 - DNA, 14 bp, Artificial Sequence
  Antisense nucleotide
tgggccgggtccgc

SEQ ID NO: 534 - DNA, 14 bp, Artificial Sequence
  Antisense nucleotide
tcccgggggtgtag

SEQ ID NO: 535 - DNA, 19 bp, Artificial Sequence
  Antisense nucleotide
agtactgtcccgggggtgt

SEQ ID NO: 536 - DNA, 18 bp, Artificial Sequence
  Antisense nucleotide
gggacacgttggggggtg

SEQ ID NO: 537 - DNA, 20 bp, Artificial Sequence
  Antisense nucleotide
gccgggggccccccggtagc

SEQ ID NO: 538 - DNA, 17 bp, Artificial Sequence
  Antisense nucleotide
cgggcccagccgggggc

SEQ ID NO: 539 - DNA, 14 bp, Artificial Sequence
  Antisense nucleotide
cgggcccagccggg

SEQ ID NO: 540 - DNA, 20 bp, Artificial Sequence
  Antisense nucleotide
gggaggtggctccgggccgg

SEQ ID NO: 541 - DNA, 18 bp, Artificial Sequence
  Antisense nucleotide
agggcggcgcgtgtggga

SEQ ID NO: 542 - DNA, 20 bp, Artificial Sequence
  Antisense nucleotide
gggtggccaccggcgaaggg

SEQ ID NO: 543 - DNA, 15 bp, Artificial Sequence
  Antisense nucleotide
aggggcaggggacgt

SEQ ID NO: 544 - DNA, 18 bp, Artificial Sequence
  Antisense nucleotide
taaaggggcaggggacgt

SEQ ID NO: 545 - DNA, 20 bp, Artificial Sequence
  Antisense nucleotide
agggggtgtccgtaaagggg

SEQ ID NO: 546 - DNA, 21 bp, Artificial Sequence
  Antisense nucleotide
ggggacgcgaacgtgccgccg

SEQ ID NO: 547 - DNA, 21 bp, Artificial Sequence
  Antisense nucleotide
cggggaacaagcggcccgggg

SEQ ID NO: 548 - DNA, 14 bp, Artificial Sequence
  Antisense nucleotide
ggccgtcgggggcg

SEQ ID NO: 549 - DNA, 15 bp, Artificial Sequence
  Antisense nucleotide
gcggccgtcgggggc

SEQ ID NO: 550 - DNA, 18 bp, Artificial Sequence
  Antisense nucleotide
aggggggtaggaggcggg

SEQ ID NO: 551 - DNA, 14 bp, Artificial Sequence
  Antisense nucleotide
gcgctgggggcgcc

SEQ ID NO: 552 - DNA, 14 bp, Artificial Sequence
  Antisense nucleotide
ggccgtcggggggt

SEQ ID NO: 553 - DNA, 15 bp, Artificial Sequence
  Antisense nucleotide
ggggaggccagcttc

SEQ ID NO: 554 - DNA, 16 bp, Artificial Sequence
  Antisense nucleotide
ggccgccaccttgggg

SEQ ID NO: 555 - DNA, 16 bp, Artificial Sequence
  Antisense nucleotide
gcggccgccgccgggg

SEQ ID NO: 556 - DNA, 20 bp, Artificial Sequence
  Antisense nucleotide
gggcgcggccgccgccgggg

SEQ ID NO: 557 - DNA, 16 bp, Artificial Sequence
  Antisense nucleotide
ggggtggcggcggcgg

SEQ ID NO: 558 - DNA, 15 bp, Artificial Sequence
  Antisense nucleotide
gggggtggcggcggc

SEQ ID NO: 559 - DNA, 18 bp, Artificial Sequence
  Antisense nucleotide
tggggcagcagctggcag

SEQ ID NO: 560 - DNA, 18 bp, Artificial Sequence
  Antisense nucleotide
cggggcgcccacgacacc

SEQ ID NO: 561 - DNA, 17 bp, Artificial Sequence
  Antisense nucleotide
cggggcgcccacgacac

SEQ ID NO: 562 - DNA, 26 bp, Artificial Sequence
  Antisense nucleotide
gggccgcaccctctccaagtccgggg

SEQ ID NO: 563 - DNA, 14 bp, Artificial Sequence
  Antisense nucleotide
gcagcagtcagtgg

SEQ ID NO: 564 - DNA, 16 bp, Artificial Sequence
  Antisense nucleotide
ccattgtctagcacgg

SEQ ID NO: 565 - DNA, 17 bp, Artificial Sequence
  Antisense nucleotide
ggtctccattgtctagc

SEQ ID NO: 566 - DNA, 16 bp, Artificial Sequence
  Antisense nucleotide
ggtggtattgttcagc

SEQ ID NO: 567 - DNA, 15 bp, Artificial Sequence
  Antisense nucleotide
gctggatcaagaccc

SEQ ID NO: 568 - DNA, 16 bp, Artificial Sequence
  Antisense nucleotide
ccacaaaatcgtgtcc

SEQ ID NO: 569 - DNA, 20 bp, Artificial
  Antisense nucleotide
ccttccacaaaatcgtgtcc

SEQ ID NO: 570 - DNA, 14 bp, Artificial Sequence
  Antisense nucleotide
ggttgttcttgtgg

SEQ ID NO: 571 - DNA, 14 bp, Artificial Sequence
  Antisense nucleotide
cctcttggttgtgc

SEQ ID NO: 572 - DNA, 20 bp, Artificial Sequence
  Antisense nucleotide
ccagagtctcaaacacttgg

SEQ ID NO: 573 - DNA, 20 bp, Artificial Sequence
  Antisense nucleotide
ggtaacctgtgatctcttcc

SEQ ID NO: 574 - DNA, 14 bp, Artificial Sequence
  Antisense nucleotide
cctgcagtactcgg

SEQ ID NO: 575 - DNA, 16 bp, Artificial Sequence
  Antisense nucleotide
ggcattcacatactcc

SEQ ID NO: 576 - DNA, 16 bp, Artificial
  Antisense nucleotide
gcaaacagtgcctggc

SEQ ID NO: 577 - DNA, 17 bp, Artificial Sequence
  Antisense nucleotide
cgcatcgtgtacttccg

SEQ ID NO: 578 - DNA, 14 bp, Artificial Sequence
  Antisense nucleotide
gcacgttccgagcg

SEQ ID NO: 579 - DNA, 15 bp, Artificial Sequence
  Antisense nucleotide
ggtaccagatactcc

SEQ ID NO: 580 - DNA, 15 bp, Artificial Sequence
  Antisense nucleotide
ccagtggagacctgg

SEQ ID NO: 581 - DNA, 17 bp, Artificial Sequence
  Antisense nucleotide
cctgaggacacatcagg

SEQ ID NO: 582 - DNA, 18 bp, Artificial Sequence
  Antisense nucleotide
cctcacttggttgtgagc

SEQ ID NO: 583 - DNA, 15 bp, Artificial Sequence
  Antisense nucleotide
ggaagatgtccttcc

SEQ ID NO: 584 - DNA, 16 bp, Artificial Sequence
  Antisense nucleotide
gcacactgctcatggc

SEQ ID NO: 585 - DNA, 15 bp, Artificial Sequence
  Antisense nucleotide
gctgtcacctcttgg

SEQ ID NO: 586 - DNA, 14 bp, Artificial Sequence
  Antisense nucleotide
cctctgctgtcacc

SEQ ID NO: 587 - DNA, 16 bp, Artificial Sequence
  Antisense nucleotide
ccacacatcactctgg

SEQ ID NO: 588 - DNA, 15 bp, Artificial Sequence
  Antisense nucleotide
cctcctcttcagagg

SEQ ID NO: 589 - DNA, 18 bp, Artificial Sequence
  Antisense nucleotide
ccttctggttcacactgg

SEQ ID NO: 590 - DNA, 16 bp, Artificial Sequence
  Antisense nucleotide
catggtgctcactgcg

SEQ ID NO: 591 - DNA, 14 bp, Artificial Sequence
  Antisense nucleotide
cttggttgtgagcg

SEQ ID NO: 592 - DNA, 14 bp, Artificial Sequence
  Antisense nucleotide
ggacaggcagtcac

SEQ ID NO: 593 - DNA, 18 bp, Artificial Sequence
  Antisense nucleotide
gtcacctcttggttgtgc

SEQ ID NO: 594 - DNA, 16 bp, Artificial Sequence
  Antisense nucleotide
ccagagtctcaaacac

SEQ ID NO: 595 - DNA, 14 bp, Artificial Sequence
  Antisense nucleotide
cacatactccctgg

SEQ ID NO: 596 - DNA, 15 bp, Artificial Sequence
  Antisense nucleotide
gaccagcacgttccg

SEQ ID NO: 597 - DNA, 17 bp, Artificial Sequence
  Antisense nucleotide
gttggtgtctatcagtg

SEQ ID NO: 598 - DNA, 14 bp, Artificial Sequence
  Antisense nucleotide
ccctggtagaggtg

SEQ ID NO: 599 - DNA, 16 bp, Artificial Sequence
  Antisense nucleotide
ctcaaacacttggagc

SEQ ID NO: 600 - DNA, 18 bp, Artificial Sequence
  Antisense nucleotide
cacacatcactctggtgg

SEQ ID NO: 601 - DNA, 15 bp, Artificial Sequence
  Antisense nucleotide
gcacagacagtgcgc

SEQ ID NO: 602 - DNA, 15 bp, Artificial Sequence
  Antisense nucleotide
catggcagcagtcag

SEQ ID NO: 603 - DNA, 16 bp, Artificial Sequence
  Antisense nucleotide
ctgctcatggcagcag

SEQ ID NO: 604 - DNA, 20 bp, Artificial Sequence
  Antisense nucleotide
catctggaaacttccagatg

SEQ ID NO: 605 - DNA, 14 bp, Artificial Sequence
  Antisense nucleotide
ctggaaacttccag

SEQ ID NO: 606 - DNA, 20 bp, Artificial Sequence
  Antisense nucleotide
cataactccacacatcactc

SEQ ID NO: 607 - DNA, 19 bp, Artificial Sequence
  Antisense nucleotide
caccataactccacacatc

SEQ ID NO: 608 - DNA, 14 bp, Artificial Sequence
  Antisense nucleotide
ctggtgggtgaacc

SEQ ID NO: 609 - DNA, 15 bp, Artificial Sequence
  Antisense nucleotide
cggattacttgcagg

SEQ ID NO: 610 - DNA, 15 bp, Artificial Sequence
  Antisense nucleotide
cgctaggtgtcagcg

SEQ ID NO: 611 - DNA, 14 bp, Artificial Sequence
  Antisense nucleotide
gccatcacgtatgc

SEQ ID NO: 612 - DNA, 17 bp, Artificial Sequence
  Antisense nucleotide
gcatacaccagttcagc

SEQ ID NO: 613 - DNA, 16 bp, Artificial Sequence
  Antisense nucleotide
ccatcaaatacatcgg

SEQ ID NO: 614 - DNA, 15 bp, Artificial Sequence
  Antisense nucleotide
ccagcagaagtcagg

SEQ ID NO: 615 - DNA, 15 bp, Artificial Sequence
  Antisense nucleotide
gcttcatgtctgtgc

SEQ ID NO: 616 - DNA, 18 bp, Artificial Sequence
  Antisense nucleotide
ggtgagttccaggtttcc

SEQ ID NO: 617 - DNA, 19 bp, Artificial Sequence
  Antisense nucleotide
ccacaaaatcgtgtcctgg

SEQ ID NO: 618 - DNA, 14 bp, Artificial Sequence
  Antisense nucleotide
cccttacacatcgg

SEQ ID NO: 619 - DNA, 15 bp, Artificial Sequence
  Antisense nucleotide
gcagctcacagatgc

SEQ ID NO: 620 - DNA, 14 bp, Artificial Sequence
  Antisense nucleotide
gcactggtaactgc

SEQ ID NO: 621 - DNA, 18 bp, Artificial Sequence
  Antisense nucleotide
cctggatattggcactgg

SEQ ID NO: 622 - DNA, 15 bp, Artificial Sequence
  Antisense nucleotide
ccagcaaactcctgg

SEQ ID NO: 623 - DNA, 15 bp, Artificial Sequence
  Antisense nucleotide
gcagaaatgccaggc

SEQ ID NO: 624 - DNA, 17 bp, Artificial Sequence
  Antisense nucleotide
ccattgtgcagaattcg

SEQ ID NO: 625 - DNA, 15 bp, Artificial Sequence
  Antisense nucleotide
ccctgcagtactcgg

SEQ ID NO: 626 - DNA, 17 bp, Artificial Sequence
  Antisense nucleotide
ggcattcacatactccc

SEQ ID NO: 627 - DNA, 16 bp, Artificial Sequence
  Antisense nucleotide
ggtcaggtttcacacc

SEQ ID NO: 628 - DNA, 15 bp, Artificial Sequence
  Antisense nucleotide
ccaggtccacacagg

SEQ ID NO: 629 - DNA, 14 bp, Artificial Sequence
  Antisense nucleotide
ccttgtcatccagg

SEQ ID NO: 630 - DNA, 14 bp, Artificial Sequence
  Antisense nucleotide
ggatcccaaagacc

SEQ ID NO: 631 - DNA, 17 bp, Artificial Sequence
  Antisense nucleotide
cctcaacactttgatgg

SEQ ID NO: 632 - DNA, 14 bp, Artificial Sequence
  Antisense nucleotide
gctgtgtcaccagc

SEQ ID NO: 633 - DNA, 16 bp, Artificial Sequence
  Antisense nucleotide
ggtctaagaggcagcc

SEQ ID NO: 634 - DNA, 17 bp, Artificial Sequence
  Antisense nucleotide
ggcaatctgcatacacc

SEQ ID NO: 635 - DNA, 14 bp, Artificial Sequence
  Antisense nucleotide
cctgtgtacgagcc

SEQ ID NO: 636 - DNA, 15 bp, Artificial Sequence
  Antisense nucleotide
ccatccacttgatgg

SEQ ID NO: 637 - DNA, 16 bp, Artificial Sequence
  Antisense nucleotide
cccacacagtcacacc

SEQ ID NO: 638 - DNA, 16 bp, Artificial Sequence
  Antisense nucleotide
ccatcgtaaggtttgg

SEQ ID NO: 639 - DNA, 14 bp, Artificial Sequence
  Antisense nucleotide
ccttttccagcagg

SEQ ID NO: 640 - DNA, 16 bp, Artificial Sequence
  Antisense nucleotide
ggagaattcagacacc

SEQ ID NO: 641 - DNA, 17 bp, Artificial Sequence
  Antisense nucleotide
ccaagtcctcattctgg

SEQ ID NO: 642 - DNA, 16 bp, Artificial Sequence
  Antisense nucleotide
ccatcagtctcagagg

SEQ ID NO: 643 - DNA, 16 bp, Artificial Sequence
  Antisense nucleotide
cctttgaaggtgctgg

SEQ ID NO: 644 - DNA, 15 bp, Artificial Sequence
  Antisense nucleotide
ggcatggcaggttcc

SEQ ID NO: 645 - DNA, 14 bp, Artificial Sequence
  Antisense nucleotide
cctggcatggcagg

SEQ ID NO: 646 - DNA, 14 bp, Artificial Sequence
  Antisense nucleotide
agatgtataggtaa

SEQ ID NO: 647 - DNA, 14 bp, Artificial Sequence
  Antisense nucleotide
attttcacattctc

SEQ ID NO: 648 - DNA, 15 bp, Artificial Sequence
  Antisense nucleotide
aattttcacattctc

SEQ ID NO: 649 - DNA, 14 bp, Artificial Sequence
  Antisense nucleotide
aattttcacattct

SEQ ID NO: 650 - DNA, 14 bp, Artificial Sequence
  Antisense nucleotide
gaattttcacattc

SEQ ID NO: 651 - DNA, 14 bp, Artificial Sequence
  Antisense nucleotide
ggaattttcacatt

SEQ ID NO: 652 - DNA, 14 bp, Artificial Sequence
  Antisense nucleotide
agatttctttgttg

SEQ ID NO: 653 - DNA, 15 bp, Artificial Sequence
  Antisense nucleotide
aagatttctttgttg

SEQ ID NO: 654 - DNA, 14 bp, Artificial Sequence
  Antisense nucleotide
aagatttctttgtt

SEQ ID NO: 655 - DNA, 15 bp, Artificial Sequence
  Antisense nucleotide
taagatttctttgtt

SEQ ID NO: 656 - DNA, 16 bp, Artificial Sequence
  Antisense nucleotide
ctaagatttctttgtt

SEQ ID NO: 657 - DNA, 14 bp, Artificial Sequence
  Antisense nucleotide
taagatttctttgt

SEQ ID NO: 658 - DNA, 15 bp, Artificial Sequence
  Antisense nucleotide
ctaagatttctttgt

SEQ ID NO: 659 - DNA, 14 bp, Artificial Sequence
  Antisense nucleotide
ctaagatttctttg

SEQ ID NO: 660 - DNA, 14 bp, Artificial Sequence
  Antisense nucleotide
tctaagatttcttt

SEQ ID NO: 661 - DNA, 15 bp, Artificial Sequence
  Antisense nucleotide
gtctaagatttcttt

SEQ ID NO: 662 - DNA, 14 bp, Artificial Sequence
  Antisense nucleotide
gtctaagatttctt

SEQ ID NO: 663 - DNA, 14 bp, Artificial Sequence
  Antisense nucleotide
ttcgtctaagattt

SEQ ID NO: 664 - DNA, 14 bp, Artificial Sequence
  Antisense nucleotide
attttgacatggtt

SEQ ID NO: 665 - DNA, 15 bp, Artificial Sequence
  Antisense nucleotide
aattttgacatggtt

SEQ ID NO: 666 - DNA, 14 bp, Artificial Sequence
  Antisense nucleotide
aattttgacatggt

SEQ ID NO: 667 - DNA, 15 bp, Artificial Sequence
  Antisense nucleotide
taattttgacatggt

SEQ ID NO: 668 - DNA, 14 bp, Artificial Sequence
  Antisense nucleotide
taattttgacatgg

SEQ ID NO: 669 - DNA, 14 bp, Artificial Sequence
  Antisense nucleotide
gtaattttgacatg

SEQ ID NO: 670 - DNA, 15 bp, Artificial Sequence
  Antisense nucleotide
tgtaattttgacatg

SEQ ID NO: 671 - DNA, 14 bp, Artificial Sequence
  Antisense nucleotide
tgtaattttgacat

SEQ ID NO: 672 - DNA, 16 bp, Artificial Sequence
  Antisense nucleotide
tctgtaattttgacat

SEQ ID NO: 673 - DNA, 14 bp, Artificial Sequence
  Antisense nucleotide
ctgtaattttgaca

SEQ ID NO: 674 - DNA, 15 bp, Artificial Sequence
  Antisense nucleotide
tctgtaattttgaca

SEQ ID NO: 675 - DNA, 14 bp, Artificial Sequence
  Antisense nucleotide
tctgtaattttgac

SEQ ID NO: 676 - DNA, 14 bp, Artificial Sequence
  Antisense nucleotide
gtctgtaattttga

SEQ ID NO: 677 - DNA, 16 bp, Artificial Sequence
  Antisense nucleotide
aagtctgtaattttga

SEQ ID NO: 678 - DNA, 14 bp, Artificial Sequence
  Antisense nucleotide
agtctgtaattttg

SEQ ID NO: 679 - DNA, 15 bp, Artificial Sequence
  Antisense nucleotide
aagtctgtaattttg

SEQ ID NO: 680 - DNA, 14 bp, Artificial Sequence
  Antisense nucleotide
aagtctgtaatttt

SEQ ID NO: 681 - DNA, 15 bp, Artificial Sequence
  Antisense nucleotide
gaagtctgtaatttt

SEQ ID NO: 682 - DNA, 14 bp, Artificial Sequence
  Antisense nucleotide
gaagtctgtaattt

SEQ ID NO: 683 - DNA, 14 bp, Artificial Sequence
  Antisense nucleotide
atgtagacatcaat

SEQ ID NO: 684 - DNA, 14 bp, Artificial Sequence
  Antisense nucleotide
atcatccaacattt

SEQ ID NO: 685 - DNA, 15 bp, Artificial Sequence
  Antisense nucleotide
aatcatccaacattt

SEQ ID NO: 686 - DNA, 14 bp, Artificial Sequence
  Antisense nucleotide
aatcatccaacatt

SEQ ID NO: 687 - DNA, 14 bp, Artificial Sequence
  Antisense nucleotide
accatcaaatacat

SEQ ID NO: 688 - DNA, 14 bp, Artificial Sequence
  Antisense nucleotide
aaaaacgtctttga

SEQ ID NO: 689 - DNA, 15 bp, Artificial Sequence
  Antisense nucleotide
ttttgttcttagaca

SEQ ID NO: 690 - DNA, 14 bp, Artificial Sequence
  Antisense nucleotide
ttttgttcttagac

SEQ ID NO: 691 - DNA, 14 bp, Artificial Sequence
  Antisense nucleotide
taaacagaaaagca

SEQ ID NO: 692 - DNA, 14 bp, Artificial Sequence
  Antisense nucleotide
actaaacagaaaag

SEQ ID NO: 693 - DNA, 16 bp, Artificial Sequence
  Antisense nucleotide
aaactaaacagaaaag

SEQ ID NO: 694 - DNA, 14 bp, Artificial Sequence
  Antisense nucleotide
aactaaacagaaaa

SEQ ID NO: 695 - DNA, 15 bp, Artificial Sequence
  Antisense nucleotide
aaactaaacagaaaa

SEQ ID NO: 696 - DNA, 14 bp, Artificial Sequence
  Antisense nucleotide
aaactaaacagaaa

SEQ ID NO: 697 - DNA, 17 bp, Artificial Sequence
  Antisense nucleotide
taaaaactaaacagaaa

SEQ ID NO: 698 - DNA, 14 bp, Artificial Sequence
  Antisense nucleotide
aaaactaaacagaa

SEQ ID NO: 699 - DNA, 17 bp, Artificial Sequence
  Antisense nucleotide
gtaaaaactaaacagaa

SEQ ID NO: 700 - DNA, 14 bp, Artificial Sequence
  Antisense nucleotide
aaaaactaaacaga

SEQ ID NO: 701 - DNA, 15 bp, Artificial Sequence
  Antisense nucleotide
taaaaactaaacaga

SEQ ID NO: 702 - DNA, 14 bp, Artificial Sequence
  Antisense nucleotide
taaaaactaaacag

SEQ ID NO: 703 - DNA, 14 bp, Artificial Sequence
  Antisense nucleotide
gtaaaaactaaaca

SEQ ID NO: 704 - DNA, 19 bp, Artificial Sequence
  Antisense nucleotide
aaaaagtaaaaactaaaca

SEQ ID NO: 705 - DNA, 14 bp, Artificial Sequence
  Antisense nucleotide
agtaaaaactaaac

SEQ ID NO: 706 - DNA, 20 bp, Artificial Sequence
  Antisense nucleotide
aaaaaaagtaaaaactaaac

SEQ ID NO: 707 - DNA, 14 bp, Artificial Sequence
  Antisense nucleotide
aagtaaaaactaaa

SEQ ID NO: 708 - DNA, 19 bp, Artificial Sequence
  Antisense nucleotide
aaaaaaagtaaaaactaaa

SEQ ID NO: 709 - DNA, 14 bp, Artificial Sequence
  Antisense nucleotide
aaagtaaaaactaa

SEQ ID NO: 710 - DNA, 14 bp, Artificial Sequence
  Antisense nucleotide
aaaagtaaaaacta

SEQ ID NO: 711 - DNA, 17 bp, Artificial Sequence
  Antisense nucleotide
aaaaaaagtaaaaacta

SEQ ID NO: 712 - DNA, 14 bp, Artificial Sequence
  Antisense nucleotide
aaaaagtaaaaact

SEQ ID NO: 713 - DNA, 16 bp, Artificial Sequence
  Antisense nucleotide
aaaaaaagtaaaaact

SEQ ID NO: 714 - DNA, 15 bp, Artificial Sequence
  Antisense nucleotide
aaaaaaagtaaaaac

SEQ ID NO: 715 - DNA, 16 bp, Artificial Sequence
  Antisense nucleotide
caaaaaaagtaaaaac

SEQ ID NO: 716 - DNA, 14 bp, Artificial Sequence
  Antisense nucleotide
aaaaaaagtaaaaa

SEQ ID NO: 717 - DNA, 14 bp, Artificial Sequence
  Antisense nucleotide
caaaaaaagtaaaa

SEQ ID NO: 718 - DNA, 20 bp, Artificial Sequence
  Antisense nucleotide
aacaaaacaaaaaaagtaaa

SEQ ID NO: 719 - DNA, 14 bp, Artificial Sequence
  Antisense nucleotide
aaacaaaaaaagta

SEQ ID NO: 720 - DNA, 16 bp, Artificial Sequence
  Antisense nucleotide
caaaacaaaaaaagta

SEQ ID NO: 721 - DNA, 15 bp, Artificial Sequence
  Antisense nucleotide
caaaacaaaaaaagt

SEQ ID NO: 722 - DNA, 14 bp, Artificial Sequence
  Antisense nucleotide
caaaacaaaaaaag

SEQ ID NO: 723 - DNA, 17 bp, Artificial Sequence
  Antisense nucleotide
ctttaaaaaaacaaaac

SEQ ID NO: 724 - DNA, 16 bp, Artificial Sequence
  Antisense nucleotide
tctttaaaaaaacaaa

SEQ ID NO: 725 - DNA, 17 bp, Artificial Sequence
  Antisense nucleotide
gtctttaaaaaaacaaa

SEQ ID NO: 726 - DNA, 15 bp, Artificial Sequence
  Antisense nucleotide
gtctttaaaaaaaca

SEQ ID NO: 727 - DNA, 14 bp, Artificial Sequence
  Antisense nucleotide
gtctttaaaaaaac

SEQ ID NO: 728 - DNA, 14 bp, Artificial Sequence
  Antisense nucleotide
tttatttcgtcttt

SEQ ID NO: 729 - DNA, 14 bp, Artificial Sequence
  Antisense nucleotide
tctttatttcgtct

SEQ ID NO: 730 - DNA, 14 bp, Artificial Sequence
  Antisense nucleotide
tatttgcaaatgga

SEQ ID NO: 731 - DNA, 15 bp, Artificial Sequence
  Antisense nucleotide
tatatttgcaaatgg

SEQ ID NO: 732 - DNA, 14 bp, Artificial Sequence
  Antisense nucleotide
tatatttgcaaatg

SEQ ID NO: 733 - DNA, 19 bp, Artificial Sequence
  Antisense nucleotide
caaaatatatttgcaaatg

SEQ ID NO: 734 - DNA, 18 bp, Artificial Sequence
  Antisense nucleotide
caaaatatatttgcaaat

SEQ ID NO: 735 - DNA, 15 bp, Artificial Sequence
  Antisense nucleotide
caaaatatatttgca

SEQ ID NO: 736 - DNA, 14 bp, Artificial Sequence
  Antisense nucleotide
caaaatatatttgc

SEQ ID NO: 737 - DNA, 16 bp, Artificial Sequence
  Antisense nucleotide
ttccaaaatatatttg

SEQ ID NO: 738 - DNA, 17 bp, Artificial Sequence
  Antisense nucleotide
ttttccaaaatatattt

SEQ ID NO: 739 - DNA, 17 bp, Artificial Sequence
  Antisense nucleotide
gttttccaaaatatatt

SEQ ID NO: 740 - DNA, 14 bp, Artificial Sequence
  Antisense nucleotide
gttttccaaaatat

SEQ ID NO: 741 - DNA, 14 bp, Artificial Sequence
  Antisense nucleotide
ggttaggcaaagcc

SEQ ID NO: 742 - DNA, 18 bp, Artificial Sequence
  Antisense nucleotide
ccgagaacatcatcgtgg

SEQ ID NO: 743 - DNA, 17 bp, Artificial Sequence
  Antisense nucleotide
ccgagaacatcatcgtg

SEQ ID NO: 744 - DNA, 15 bp, Artificial Sequence
  Antisense nucleotide
ccgagaacatcatcg

SEQ ID NO: 745 - DNA, 18 bp, Artificial Sequence
  Antisense nucleotide
cgtagtctgcgttgaagc

SEQ ID NO: 746 - DNA, 15 bp, Artificial Sequence
  Antisense nucleotide
ccatgctggagaagg

SEQ ID NO: 747 - DNA, 14 bp, Artificial Sequence
  Antisense nucleotide
ccgtgcagaagtcc

SEQ ID NO: 748 - DNA, 14 bp, Artificial Sequence
  Antisense nucleotide
ggaatgaagttggc

SEQ ID NO: 749 - DNA, 14 bp, Artificial Sequence
  Antisense nucleotide
tgaccgtgggaatg

SEQ ID NO: 750 - DNA, 14 bp, Artificial Sequence
  Antisense nucleotide
tggcagtgaccgtg

SEQ ID NO: 751 - DNA, 14 bp, Artificial Sequence
  Antisense nucleotide
agatggcagtgacc

SEQ ID NO: 752 - DNA, 16 bp, Artificial Sequence
  Antisense nucleotide
cgagatggcagtgacc

SEQ ID NO: 753 - DNA, 14 bp, Artificial Sequence
  Antisense nucleotide
ccagccactgcagg

SEQ ID NO: 754 - DNA, 14 bp, Artificial Sequence
  Antisense nucleotide
gcaccagccactgc

SEQ ID NO: 755 - DNA, 14 bp, Artificial Sequence
  Antisense nucleotide
ccctggagtaagcc

SEQ ID NO: 756 - DNA, 18 bp, Artificial Sequence
  Antisense nucleotide
ggagataactgttccacc

SEQ ID NO: 757 - DNA, 15 bp, Artificial Sequence
  Antisense nucleotide
ggagataactgttcc

SEQ ID NO: 758 - DNA, 15 bp, Artificial Sequence
  Antisense nucleotide
cttctagttggtctg

SEQ ID NO: 759 - DNA, 14 bp, Artificial Sequence
  Antisense nucleotide
catcttctagttgg

SEQ ID NO: 760 - DNA, 17 bp, Artificial Sequence
  Antisense nucleotide
tctcatcttctagttgg

SEQ ID NO: 761 - DNA, 18 bp, Artificial Sequence
  Antisense nucleotide
ctgcaaagcagacttctc

SEQ ID NO: 762 - DNA, 15 bp, Artificial Sequence
  Antisense nucleotide
ccttcagcaggttgg

SEQ ID NO: 763 - DNA, 14 bp, Artificial Sequence
  Antisense nucleotide
cccaggtcatcagg

SEQ ID NO: 764 - DNA, 15 bp, Artificial Sequence
  Antisense nucleotide
ccagtcagatcaagg

SEQ ID NO: 765 - DNA, 15 bp, Artificial Sequence
  Antisense nucleotide
ggtgaaggcctcctc

SEQ ID NO: 766 - DNA, 15 bp, Artificial Sequence
  Antisense nucleotide
cagggtgaaggcctc

SEQ ID NO: 767 - DNA, 15 bp, Artificial Sequence
  Antisense nucleotide
cctggatgatgctgg

SEQ ID NO: 768 - DNA, 14 bp, Artificial Sequence
  Antisense nucleotide
ccactgtgcagagg

SEQ ID NO: 769 - DNA, 15 bp, Artificial Sequence
  Antisense nucleotide
ggagtacaggtgacc

SEQ ID NO: 770 - DNA, 15 bp, Artificial Sequence
  Antisense nucleotide
gctcattgctgctgc

SEQ ID NO: 771 - DNA, 17 bp, Artificial Sequence
  Antisense nucleotide
ggaaggctcattgctgc

SEQ ID NO: 772 - DNA, 14 bp, Artificial Sequence
  Antisense nucleotide
ttttctcttcttct

SEQ ID NO: 773 - DNA, 14 bp, Artificial Sequence
  Antisense nucleotide
atcttattcctttc

SEQ ID NO: 774 - DNA, 14 bp, Artificial Sequence
  Antisense nucleotide
catcttattccttt

SEQ ID NO: 775 - DNA, 14 bp, Artificial Sequence
  Antisense nucleotide
tagtttttccttct

SEQ ID NO: 776 - DNA, 14 bp, Artificial Sequence
  Antisense nucleotide
tctagtttttcctt

SEQ ID NO: 777 - DNA, 14 bp, Artificial Sequence
  Antisense nucleotide
aactctagtttttc

SEQ ID NO: 778 - DNA, 14 bp, Artificial Sequence
  Antisense nucleotide
gaactctagttttt

SEQ ID NO: 779 - DNA, 15 bp, Artificial Sequence
  Antisense nucleotide
tgaactctagttttt

SEQ ID NO: 780 - DNA, 16 bp, Artificial Sequence
  Antisense nucleotide
atgaactctagttttt

SEQ ID NO: 781 - DNA, 14 bp, Artificial Sequence
  Antisense nucleotide
tgaactctagtttt

SEQ ID NO: 782 - DNA, 15 bp, Artificial Sequence
  Antisense nucleotide
atgaactctagtttt

SEQ ID NO: 783 - DNA, 14 bp, Artificial Sequence
  Antisense nucleotide
atgaactctagttt

SEQ ID NO: 784 - DNA, 14 bp, Artificial Sequence
  Antisense nucleotide
gcacacagtagtgc

SEQ ID NO: 785 - DNA, 16 bp, Artificial Sequence
  Antisense nucleotide
gcaggatcagaaaagc

SEQ ID NO: 786 - DNA, 14 bp, Artificial Sequence
  Antisense nucleotide
gcaggtagacaggc

SEQ ID NO: 787 - DNA, 17 bp, Artificial Sequence
  Antisense nucleotide
gcttgctcaggatctgc

SEQ ID NO: 788 - DNA, 15 bp, Artificial Sequence
  Antisense nucleotide
gcaagtccctggtgc

SEQ ID NO: 789 - DNA, 14 bp, Artificial Sequence
  Antisense nucleotide
cctggagcaagtcc

SEQ ID NO: 790 - DNA, 17 bp, Artificial Sequence
  Antisense nucleotide
cgtagtactcttcgtcg

SEQ ID NO: 791 - DNA, 14 bp, Artificial Sequence
  Antisense nucleotide
cgtagtactcttcg

SEQ ID NO: 792 - DNA, 14 bp, Artificial Sequence
  Antisense nucleotide
gtaaacctccttgg

SEQ ID NO: 793 - DNA, 19 bp, Artificial Sequence
  Antisense nucleotide
gtctattttgtaaacctcc

SEQ ID NO: 794 - DNA, 20 bp, Artificial Sequence
  Antisense nucleotide
gcatgtctattttgtaaacc

SEQ ID NO: 795 - DNA, 15 bp, Artificial Sequence
  Antisense nucleotide
ggcatcaaggtaccc

SEQ ID NO: 796 - DNA, 14 bp, Artificial
  Antisense nucleotide
ggcatcaaggtacc

SEQ ID NO: 797 - DNA, 20 bp, Artificial Sequence
  Antisense nucleotide
gctttcaccaaattggaagc

SEQ ID NO: 798 - DNA, 18 bp, Artificial Sequence
  Antisense nucleotide
gagaatctgatatagctc

SEQ ID NO: 799 - DNA, 19 bp, Artificial Sequence
  Antisense nucleotide
ggagatgttaaatctttgg

SEQ ID NO: 800 - DNA, 14 bp, Artificial
  Antisense nucleotide
gctgtcgatgtagc

SEQ ID NO: 801 - DNA, 20 bp, Artificial
  Antisense nucleotide
ccaggttcctgtctttatgg

SEQ ID NO: 802 - DNA, 14 bp, Artificial Sequence
  Antisense nucleotide
cagcagggacagtg

SEQ ID NO: 803 - DNA, 19 bp, Artificial Sequence
  Antisense nucleotide
cttgcttctagttcttcac

SEQ ID NO: 804 - DNA, 15 bp, Artificial Sequence
  Antisense nucleotide
gccatcaatacctgc

SEQ ID NO: 805 - DNA, 15 bp, Artificial Sequence
  Antisense nucleotide
ggtgccatcaatacc

SEQ ID NO: 806 - DNA, 16 bp, Artificial Sequence
  Antisense nucleotide
ccactggtatatgtgg

SEQ ID NO: 807 - DNA, 18 bp, Artificial Sequence
  Antisense nucleotide
ggactttatagttttctg

SEQ ID NO: 808 - DNA, 16 bp, Artificial Sequence
  Antisense nucleotide
ctcaagtctgtaggag

SEQ ID NO: 809 - DNA, 15 bp, Artificial Sequence
  Antisense nucleotide
ggtctgttgtgactc

SEQ ID NO: 810 - DNA, 19 bp, Artificial Sequence
  Antisense nucleotide
caattatcctgcacatttc

SEQ ID NO: 811 - DNA, 16 bp, Artificial Sequence
  Antisense nucleotide
gcagcaattatcctgc

SEQ ID NO: 812 - DNA, 14 bp, Artificial Sequence
  Antisense nucleotide
ggcagcaattatcc

SEQ ID NO: 813 - DNA, 19 bp, Artificial Sequence
  Antisense nucleotide
ggttcgtgtatccatttcc

SEQ ID NO: 814 - DNA, 14 bp, Artificial Sequence
  Antisense nucleotide
gcacagaagttggc

SEQ ID NO: 815 - DNA, 16 bp, Artificial Sequence
  Antisense nucleotide
ccagcacagaagttgg

SEQ ID NO: 816 - DNA, 14 bp, Artificial Sequence
  Antisense nucleotide
gtgctgagtgtctg

SEQ ID NO: 817 - DNA, 16 bp, Artificial Sequence
  Antisense nucleotide
cctgctgtgctgagtg

SEQ ID NO: 818 - DNA, 14 bp, Artificial Sequence
  Antisense nucleotide
gctcaggaccctgc

SEQ ID NO: 819 - DNA, 15 bp, Artificial Sequence
  Antisense nucleotide
gcagcaaggagaagc

SEQ ID NO: 820 - DNA, 19 bp, Artificial Sequence
  Antisense nucleotide
ccaatgtagtagagaatgg

SEQ ID NO: 821 - DNA, 14 bp, Artificial Sequence
  Antisense nucleotide
gctgcatttgcaag

SEQ ID NO: 822 - DNA, 14 bp, Artificial Sequence
  Antisense nucleotide
aaaaaagaaatcaa

SEQ ID NO: 823 - DNA, 15 bp, Artificial Sequence
  Antisense nucleotide
aaaaaaagaaatcaa

SEQ ID NO: 824 - DNA, 16 bp, Artificial Sequence
  Antisense nucleotide
aaaaaaaagaaatcaa

SEQ ID NO: 825 - DNA, 17 bp, Artificial Sequence
  Antisense nucleotide
taaaaaaaagaaatcaa

SEQ ID NO: 826 - DNA, 18 bp, Artificial Sequence
  Antisense nucleotide
ataaaaaaaagaaatcaa

SEQ ID NO: 827 - DNA, 19 bp, Artificial Sequence
  Antisense nucleotide
aataaaaaaaagaaatcaa

SEQ ID NO: 828 - DNA, 17 bp, Artificial Sequence
  Antisense nucleotide
gaataaaaaaaagaaat

SEQ ID NO: 829 - DNA, 18 bp, Artificial Sequence
  Antisense nucleotide
agaataaaaaaaagaaat

SEQ ID NO: 830 - DNA, 14 bp, Artificial Sequence
  Antisense nucleotide
cagaataaaaaaaa

SEQ ID NO: 831 - DNA, 14 bp, Artificial Sequence
  Antisense nucleotide
tcagaataaaaaaa

SEQ ID NO: 832 - DNA, 14 bp, Artificial Sequence
  Antisense nucleotide
ttgtttttaaaagt

SEQ ID NO: 833 - DNA, 14 bp, Artificial Sequence
  Antisense nucleotide
agttgtttttaaaa

SEQ ID NO: 834 - DNA, 15 bp, Artificial Sequence
  Antisense nucleotide
aagttgtttttaaaa

SEQ ID NO: 835 - DNA, 16 bp, Artificial Sequence
  Antisense nucleotide
aaagttgtttttaaaa

SEQ ID NO: 836 - DNA, 17 bp, Artificial Sequence
  Antisense nucleotide
aaaagttgtttttaaaa

SEQ ID NO: 837 - DNA, 18 bp, Artificial Sequence
  Antisense nucleotide
aaaaagttgtttttaaaa

SEQ ID NO: 838 - DNA, 19 bp, Artificial Sequence
  Antisense nucleotide
aaaaaagttgtttttaaaa

SEQ ID NO: 839 - DNA, 20 bp, Artificial Sequence
  Antisense nucleotide
aaaaaaagttgtttttaaaa

SEQ ID NO: 840 - DNA, 20 bp, Artificial Sequence
  Antisense nucleotide
aaaaaaaagttgtttttaaa

SEQ ID NO: 841 - DNA, 14 bp, Artificial Sequence
  Antisense nucleotide
tttttaaaaaagtg

SEQ ID NO: 842 - DNA, 15 bp, Artificial Sequence
  Antisense nucleotide
ttttttaaaaaagtg

SEQ ID NO: 843 - DNA, 16 bp, Artificial Sequence
  Antisense nucleotide
attttttaaaaaagtg

SEQ ID NO: 844 - DNA, 16 bp, Artificial Sequence
  Antisense nucleotide
cattttttaaaaaagt

SEQ ID NO: 845 - DNA, 15 bp, Artificial Sequence
  Antisense nucleotide
gcattttttaaaaaa

SEQ ID NO: 846 - DNA, 16 bp, Artificial Sequence
  Antisense nucleotide
tgcattttttaaaaaa

SEQ ID NO: 847 - DNA, 14 bp, Artificial Sequence
  Antisense nucleotide
agcttattttaaat

SEQ ID NO: 848 - DNA, 15 bp, Artificial Sequence
  Antisense nucleotide
aagcttattttaaat

SEQ ID NO: 849 - DNA, 16 bp, Artificial Sequence
  Antisense nucleotide
taagcttattttaaat

SEQ ID NO: 850 - DNA, 14 bp, Artificial Sequence
  Antisense nucleotide
tgtaattattagat

SEQ ID NO: 851 - DNA, 15 bp, Artificial Sequence
  Antisense nucleotide
atgtaattattagat

SEQ ID NO: 852 - DNA, 14 bp, Artificial Sequence
  Antisense nucleotide
tgatgtaattatta

SEQ ID NO: 853 - DNA, 15 bp, Artificial Sequence
  Antisense nucleotide
atgatgtaattatta

SEQ ID NO: 854 - DNA, 14 bp, Artificial Sequence
  Antisense nucleotide
atggtattatataa

SEQ ID NO: 855 - DNA, 15 bp, Artificial Sequence
  Antisense nucleotide
tatggtattatataa

SEQ ID NO: 856 - DNA, 16 bp, Artificial Sequence
  Antisense nucleotide
ttatggtattatataa

SEQ ID NO: 857 - DNA, 17 bp, Artificial Sequence
  Antisense nucleotide
tttatggtattatataa

SEQ ID NO: 858 - DNA, 18 bp, Artificial Sequence
  Antisense nucleotide
atttatggtattatataa

SEQ ID NO: 859 - DNA, 14 bp, Artificial Sequence
  Antisense nucleotide
aatcatattagaaa

SEQ ID NO: 860 - DNA, 14 bp, Artificial Sequence
  Antisense nucleotide
ttacaatcatatta

SEQ ID NO: 861 - DNA, 15 bp, Artificial Sequence
  Antisense nucleotide
tttacaatcatatta

SEQ ID NO: 862 - DNA, 16 bp, Artificial Sequence
  Antisense nucleotide
ggcatgacgcctttcc

SEQ ID NO: 863 - DNA, 14 bp, Artificial Sequence
  Antisense nucleotide
gcatgacgcctttc

SEQ ID NO: 864 - DNA, 14 bp, Artificial Sequence
  Antisense nucleotide
gcctgacgagaggc

SEQ ID NO: 865 - DNA, 15 bp, Artificial Sequence
  Antisense nucleotide
ctcaagcctgacgag

SEQ ID NO: 866 - DNA, 16 bp, Artificial Sequence
  Antisense nucleotide
ccacagttcctttttc

SEQ ID NO: 867 - DNA, 18 bp, Artificial Sequence
  Antisense nucleotide
gctgcaataaagatacag

SEQ ID NO: 868 - DNA, 16 bp, Artificial Sequence
  Antisense nucleotide
gctgcaataaagatac

SEQ ID NO: 869 - DNA, 17 bp, Artificial Sequence
  Antisense nucleotide
ggacactgatttctatg

SEQ ID NO: 870 - DNA, 16 bp, Artificial Sequence
  Antisense nucleotide
gcattatcaactttgg

SEQ ID NO: 871 - DNA, 16 bp, Artificial Sequence
  Antisense nucleotide
acttttagcaccaatg

SEQ ID NO: 872 - DNA, 19 bp, Artificial Sequence
  Antisense nucleotide
ccaagaaacttttagcacc

SEQ ID NO: 873 - DNA, 14 bp, Artificial Sequence
  Antisense nucleotide
ccagatcatcttcc

SEQ ID NO: 874 - DNA, 16 bp, Artificial Sequence
  Antisense nucleotide
agtcaaggacacatag

SEQ ID NO: 875 - DNA, 16 bp, Artificial Sequence
  Antisense nucleotide
tctttgagcaacatgg

SEQ ID NO: 876 - DNA, 14 bp, Artificial Sequence
  Antisense nucleotide
gggtataacagctg

SEQ ID NO: 877 - DNA, 18 bp, Artificial Sequence
  Antisense nucleotide
gaggtgaaccattaatgg

SEQ ID NO: 878 - DNA, 16 bp, Artificial Sequence
  Antisense nucleotide
tcttcgtatcgtttag

SEQ ID NO: 879 - DNA, 15 bp, Artificial Sequence
  Antisense nucleotide
tgttggatagtgttc

SEQ ID NO: 880 - DNA, 15 bp, Artificial Sequence
  Antisense nucleotide
gttgatcacttgctg

SEQ ID NO: 881 - DNA, 15 bp, Artificial Sequence
  Antisense nucleotide
ggattccattactcg

SEQ ID NO: 882 - DNA, 20 bp, Artificial Sequence
  Antisense nucleotide
gacatatgaaaaatgttgtc

SEQ ID NO: 883 - DNA, 17 bp, Artificial Sequence
  Antisense nucleotide
gccaataaagacatatg

SEQ ID NO: 884 - DNA, 17 bp, Artificial Sequence
  Antisense nucleotide
ccagaatcaagattctg

SEQ ID NO: 885 - DNA, 16 bp, Artificial Sequence
  Antisense nucleotide
ctgttccagaatcaag

SEQ ID NO: 886 - DNA, 20 bp, Artificial Sequence
  Antisense nucleotide
gacaaatctgttccagaatc

SEQ ID NO: 887 - DNA, 19 bp, Artificial Sequence
  Antisense nucleotide
ggaaagacaaatctgttcc

SEQ ID NO: 888 - DNA, 16 bp, Artificial Sequence
  Antisense nucleotide
gattaagaggacaagc

SEQ ID NO: 889 - DNA, 14 bp, Artificial Sequence
  Antisense nucleotide
ggaagattaagagg

SEQ ID NO: 890 - DNA, 18 bp, Artificial Sequence
  Antisense nucleotide
gcagtgtgattattctgg

SEQ ID NO: 891 - DNA, 19 bp, Artificial Sequence
  Antisense nucleotide
ggagaaagatacatatctg

SEQ ID NO: 892 - DNA, 14 bp, Artificial Sequence
  Antisense nucleotide
ggagatcttacagg

SEQ ID NO: 893 - DNA, 20 bp, Artificial
  Antisense nucleotide
gcatttgcagtagaatttac

SEQ ID NO: 894 - DNA, 14 bp, Artificial Sequence
  Antisense nucleotide
cagtgaaagagagg

SEQ ID NO: 895 - DNA, 14 bp, Artificial Sequence
  Antisense nucleotide
gctagccgatacac

SEQ ID NO: 896 - DNA, 17 bp, Artificial Sequence
  Antisense nucleotide
ggaagatccttgtatgc

SEQ ID NO: 897 - DNA, 15 bp, Artificial Sequence
  Antisense nucleotide
gcatgaggaagatcc

SEQ ID NO: 898 - DNA, 16 bp, Artificial Sequence
  Antisense nucleotide
ggagtcatttttgttg

SEQ ID NO: 899 - DNA, 19 bp, Artificial Sequence
  Antisense nucleotide
ccaattgatactaagattc

SEQ ID NO: 900 - DNA, 15 bp, Artificial Sequence
  Antisense nucleotide
tcttttgagcacacg

SEQ ID NO: 901 - DNA, 18 bp, Artificial Sequence
  Antisense nucleotide
ccttcagcacttcttttg

SEQ ID NO: 902 - DNA, 16 bp, Artificial Sequence
  Antisense nucleotide
ggttgcttccttcagc

SEQ ID NO: 903 - DNA, 14 bp, Artificial Sequence
  Antisense nucleotide
cagtggtttaggag

SEQ ID NO: 904 - DNA, 17 bp, Artificial Sequence
  Antisense nucleotide
cctgagatcctcatttc

SEQ ID NO: 905 - DNA, 17 bp, Artificial Sequence
  Antisense nucleotide
ccaaggtcctgagatcc

SEQ ID NO: 906 - DNA, 16 bp, Artificial
  Antisense nucleotide
ggtgtacacagtgtcc

SEQ ID NO: 907 - DNA, 14 bp, Artificial Sequence
  Antisense nucleotide
tatctttaatttct

SEQ ID NO: 908 - DNA, 14 bp, Artificial Sequence
  Antisense nucleotide
tcttttgaatataa

SEQ ID NO: 909 - DNA, 15 bp, Artificial Sequence
  Antisense nucleotide
ttcttttgaatataa

SEQ ID NO: 910 - DNA, 16 bp, Artificial Sequence
  Antisense nucleotide
tttcttttgaatataa

SEQ ID NO: 911 - DNA, 17 bp, Artificial Sequence
  Antisense nucleotide
ttttcttttgaatataa

SEQ ID NO: 912 - DNA, 18 bp, Artificial Sequence
  Antisense nucleotide
tttttcttttgaatataa

SEQ ID NO: 913 - DNA, 14 bp, Artificial Sequence
  Antisense nucleotide
atttctatgttttt

SEQ ID NO: 914 - DNA, 14 bp, Artificial Sequence
  Antisense nucleotide
ttaaagaatttatg

SEQ ID NO: 915 - DNA, 14 bp, Artificial Sequence
  Antisense nucleotide
gttaaagaatttat

SEQ ID NO: 916 - DNA, 15 bp, Artificial Sequence
  Antisense nucleotide
agttaaagaatttat

SEQ ID NO: 917 - DNA, 16 bp, Artificial Sequence
  Antisense nucleotide
aagttaaagaatttat

SEQ ID NO: 918 - DNA, 17 bp, Artificial Sequence
  Antisense nucleotide
taagttaaagaatttat

SEQ ID NO: 919 - DNA, 14 bp, Artificial Sequence
  Antisense nucleotide
tttagtaagttaaa

SEQ ID NO: 920 - DNA, 15 bp, Artificial Sequence
  Antisense nucleotide
ttttagtaagttaaa

SEQ ID NO: 921 - DNA, 14 bp, Artificial Sequence
  Antisense nucleotide
atttcttttagtaa

SEQ ID NO: 922 - DNA, 15 bp, Artificial Sequence
  Antisense nucleotide
aatttcttttagtaa

SEQ ID NO: 923 - DNA, 14 bp, Artificial Sequence
  Antisense nucleotide
atcaatttctttta

SEQ ID NO: 924 - DNA, 15 bp, Artificial Sequence
  Antisense nucleotide
tatcaatttctttta

SEQ ID NO: 925 - DNA, 14 bp, Artificial Sequence
  Antisense nucleotide
aatatataagttca

SEQ ID NO: 926 - DNA, 15 bp, Artificial Sequence
  Antisense nucleotide
aaatatataagttca

SEQ ID NO: 927 - DNA, 14 bp, Artificial Sequence
  Antisense nucleotide
caaatatataagtt

SEQ ID NO: 928 - DNA, 15 bp, Artificial Sequence
  Antisense nucleotide
tcaaatatataagtt

SEQ ID NO: 929 - DNA, 14 bp, Artificial Sequence
  Antisense nucleotide
tgtcaaatatataa

SEQ ID NO: 930 - DNA, 14 bp, Artificial Sequence
  Antisense nucleotide
aatttatttcagta

SEQ ID NO: 931 - DNA, 14 bp, Artificial Sequence
  Antisense nucleotide
aataaaaatgtgat

SEQ ID NO: 932 - DNA, 15 bp, Artificial Sequence
  Antisense nucleotide
taataaaaatgtgat

SEQ ID NO: 933 - DNA, 14 bp, Artificial Sequence
  Antisense nucleotide
tagctaataaaaat

SEQ ID NO: 934 - DNA, 15 bp, Artificial Sequence
  Antisense nucleotide
ttagctaataaaaat

SEQ ID NO: 935 - DNA, 16 bp, Artificial Sequence
  Antisense nucleotide
tttagctaataaaaat

SEQ ID NO: 936 - DNA, 14 bp, Artificial Sequence
  Antisense nucleotide
aataaaatagtcaa

SEQ ID NO: 937 - DNA, 15 bp, Artificial Sequence
  Antisense nucleotide
taataaaatagtcaa

SEQ ID NO: 938 - DNA, 16 bp, Artificial Sequence
  Antisense nucleotide
ttaataaaatagtcaa

SEQ ID NO: 939 - DNA, 17 bp, Artificial Sequence
  Antisense nucleotide
tttaataaaatagtcaa

SEQ ID NO: 940 - DNA, 15 bp, Artificial Sequence
  Antisense nucleotide
gtttaataaaatagt

SEQ ID NO: 941 - DNA, 16 bp, Artificial Sequence
  Antisense nucleotide
agtttaataaaatagt

SEQ ID NO: 942 - DNA, 15 bp, Artificial Sequence
  Antisense nucleotide
gagtttaataaaata

SEQ ID NO: 943 - DNA, 16 bp, Artificial Sequence
  Antisense nucleotide
agagtttaataaaata

SEQ ID NO: 944 - DNA, 14 bp, Artificial Sequence
  Antisense nucleotide
aataattcttgtat

SEQ ID NO: 945 - DNA, 14 bp, Artificial Sequence
  Antisense nucleotide
tatattacattcat

SEQ ID NO: 946 - DNA, 14 bp, Artificial Sequence
  Antisense nucleotide
atctatattacatt

SEQ ID NO: 947 - DNA, 14 bp, Artificial Sequence
  Antisense nucleotide
ataaacatttttca

SEQ ID NO: 948 - DNA, 15 bp, Artificial Sequence
  Antisense nucleotide
aataaacatttttca

SEQ ID NO: 949 - DNA, 16 bp, Artificial Sequence
  Antisense nucleotide
aaataaacatttttca

SEQ ID NO: 950 - DNA, 15 bp, Artificial Sequence
  Antisense nucleotide
gaaataaacattttt

SEQ ID NO: 951 - DNA, 16 bp, Artificial Sequence
  Antisense nucleotide
tgaaataaacattttt

SEQ ID NO: 952 - DNA, 17 bp, Artificial Sequence
  Antisense nucleotide
ttgaaataaacattttt

SEQ ID NO: 953 - DNA, 18 bp, Artificial Sequence
  Antisense nucleotide
tttgaaataaacattttt

SEQ ID NO: 954 - DNA, 19 bp, Artificial Sequence
  Antisense nucleotide
ttttgaaataaacattttt

SEQ ID NO: 955 - DNA, 20 bp, Artificial Sequence
  Antisense nucleotide
tttttgaaataaacattttt

SEQ ID NO: 956 - DNA, 20 bp, Artificial Sequence
  Antisense nucleotide
atttttgaaataaacatttt

SEQ ID NO: 957 - DNA, 19 bp, Artificial Sequence
  Antisense nucleotide
aatttttgaaataaacatt

SEQ ID NO: 958 - DNA, 20 bp, Artificial Sequence
  Antisense nucleotide
aaatttttgaaataaacatt

SEQ ID NO: 959 - DNA, 20 bp, Artificial Sequence
  Antisense nucleotide
aaaatttttgaaataaacat

SEQ ID NO: 960 - DNA, 20 bp, Artificial Sequence
  Antisense nucleotide
taaaatttttgaaataaaca

SEQ ID NO: 961 - DNA, 20 bp, Artificial Sequence
  Antisense nucleotide
ataaaatttttgaaataaac

SEQ ID NO: 962 - DNA, 20 bp, Artificial Sequence
  Antisense nucleotide
tataaaatttttgaaataaa

SEQ ID NO: 963 - DNA, 18 bp, Artificial Sequence
  Antisense nucleotide
gtataaaatttttgaaat

SEQ ID NO: 964 - DNA, 14 bp, Artificial Sequence
  Antisense nucleotide
ggtataaaattttt

SEQ ID NO: 965 - DNA, 15 bp, Artificial Sequence
  Antisense nucleotide
aggtataaaattttt

SEQ ID NO: 966 - DNA, 16 bp, Artificial Sequence
  Antisense nucleotide
aaggtataaaattttt

SEQ ID NO: 967 - DNA, 17 bp, Artificial Sequence
  Antisense nucleotide
aaaggtataaaattttt

SEQ ID NO: 968 - DNA, 18 bp, Artificial Sequence
  Antisense nucleotide
aaaaggtataaaattttt

SEQ ID NO: 969 - DNA, 19 bp, Artificial Sequence
  Antisense nucleotide
taaaaggtataaaattttt

SEQ ID NO: 970 - DNA, 20 bp, Artificial Sequence
  Antisense nucleotide
ataaaaggtataaaattttt

SEQ ID NO: 971 - DNA, 14 bp, Artificial Sequence
  Antisense nucleotide
tttagaaagatttt

SEQ ID NO: 972 - DNA, 14 bp, Artificial
  Antisense nucleotide
aagataaatttctt

SEQ ID NO: 973 - DNA, 15 bp, Artificial Sequence
  Antisense nucleotide
taagataaatttctt

SEQ ID NO: 974 - DNA, 16 bp, Artificial Sequence
  Antisense nucleotide
ttaagataaatttctt

SEQ ID NO: 975 - DNA, 17 bp, Artificial Sequence
  Antisense nucleotide
tttaagataaatttctt

SEQ ID NO: 976 - DNA, 18 bp, Artificial Sequence
  Antisense nucleotide
ttttaagataaatttctt

SEQ ID NO: 977 - DNA, 19 bp, Artificial Sequence
  Antisense nucleotide
tttttaagataaatttctt

SEQ ID NO: 978 - DNA, 20 bp, Artificial
  Antisense nucleotide
atttttaagataaatttctt

SEQ ID NO: 979 - DNA, 20 bp, Artificial Sequence
  Antisense nucleotide
tatttttaagataaatttct

SEQ ID NO: 980 - DNA, 18 bp, Artificial Sequence
  Antisense nucleotide
ttatttttaagataaatt

SEQ ID NO: 981 - DNA, 19 bp, Artificial Sequence
  Antisense nucleotide
tttatttttaagataaatt

SEQ ID NO: 982 - DNA, 19 bp, Artificial Sequence
  Antisense nucleotide
ctttatttttaagataaat

SEQ ID NO: 983 - DNA, 20 bp, Artificial Sequence
  Antisense nucleotide
tctttatttttaagataaat

SEQ ID NO: 984 - DNA, 20 bp, Artificial Sequence
  Antisense nucleotide
atctttatttttaagataaa

SEQ ID NO: 985 - DNA, 14 bp, Artificial Sequence
  Antisense nucleotide
atctttatttttaa

SEQ ID NO: 986 - DNA, 15 bp, Artificial Sequence
  Antisense nucleotide
gatctttatttttaa

SEQ ID NO: 987 - DNA, 16 bp, Artificial Sequence
  Antisense nucleotide
agatctttatttttaa

SEQ ID NO: 988 - DNA, 17 bp, Artificial Sequence
  Antisense nucleotide
tagatctttatttttaa

SEQ ID NO: 989 - DNA, 14 bp, Artificial Sequence
  Antisense nucleotide
aatcatcattaatt

SEQ ID NO: 990 - DNA, 15 bp, Artificial Sequence
  Antisense nucleotide
aaatcatcattaatt

SEQ ID NO: 991 - DNA, 16 bp, Artificial Sequence
  Antisense nucleotide
aaaatcatcattaatt

SEQ ID NO: 992 - DNA, 17 bp, Artificial Sequence
  Antisense nucleotide
taaaatcatcattaatt

SEQ ID NO: 993 - DNA, 18 bp, Artificial Sequence
  Antisense nucleotide
ttaaaatcatcattaatt

SEQ ID NO: 994 - DNA, 19 bp, Artificial Sequence
  Antisense nucleotide
tttaaaatcatcattaatt

SEQ ID NO: 995 - DNA, 20 bp, Artificial Sequence
  Antisense nucleotide
atttaaaatcatcattaatt

SEQ ID NO: 996 - DNA, 19 bp, Artificial Sequence
  Antisense nucleotide
aatttaaaatcatcattaa

SEQ ID NO: 997 - DNA, 14 bp, Artificial Sequence
  Antisense nucleotide
gaatttaaaatcat

SEQ ID NO: 998 - DNA, 15 bp, Artificial Sequence
  Antisense nucleotide
tgaatttaaaatcat

SEQ ID NO: 999 - DNA, 14 bp, Artificial Sequence
  Antisense nucleotide
ttaaaataggaaat

SEQ ID NO: 1000 - DNA, 14 bp, Artificial Sequence
  Antisense nucleotide
aatttctctttaaa

SEQ ID NO: 1001 - DNA, 15 bp, Artificial Sequence
  Antisense nucleotide
aaatttctctttaaa

SEQ ID NO: 1002 - DNA, 14 bp, Artificial Sequence
  Antisense nucleotide
taaaattttgaatg

SEQ ID NO: 1003 - DNA, 14 bp, Artificial Sequence
  Antisense nucleotide
ctaaaattttgaat

SEQ ID NO: 1004 - DNA, 14 bp, Artificial Sequence
  Antisense nucleotide
tttgctaaaatttt

SEQ ID NO: 1005 - DNA, 14 bp, Artificial Sequence
  Antisense nucleotide
atatgaaaaatgtt

SEQ ID NO: 1006 - DNA, 14 bp, Artificial Sequence
  Antisense nucleotide
ttttaaattaagca

SEQ ID NO: 1007 - DNA, 14 bp, Artificial Sequence
  Antisense nucleotide
ttgtaaaaatcaaa

SEQ ID NO: 1008 - DNA, 15 bp, Artificial Sequence
  Antisense nucleotide
tttgtaaaaatcaaa

SEQ ID NO: 1009 - DNA, 14 bp, Artificial Sequence
  Antisense nucleotide
tttgataaaacttt

SEQ ID NO: 1010 - DNA, 14 bp, Artificial Sequence
  Antisense nucleotide
atgttttatcattt

SEQ ID NO: 1011 - DNA, 15 bp, Artificial Sequence
  Antisense nucleotide
aatgttttatcattt

SEQ ID NO: 1012 - DNA, 16 bp, Artificial Sequence
  Antisense nucleotide
aaatgttttatcattt

SEQ ID NO: 1013 - DNA, 17 bp, Artificial Sequence
  Antisense nucleotide
taaatgttttatcattt

SEQ ID NO: 1014 - DNA, 14 bp, Artificial Sequence
  Antisense nucleotide
tctaaatgttttat

SEQ ID NO: 1015 - DNA, 15 bp, Artificial Sequence
  Antisense nucleotide
ttctaaatgttttat

SEQ ID NO: 1016 - DNA, 14 bp, Artificial Sequence
  Antisense nucleotide
taagatcaaataaa

SEQ ID NO: 1017 - DNA, 15 bp, Artificial Sequence
  Antisense nucleotide
ataagatcaaataaa

SEQ ID NO: 1018 - DNA, 16 bp, Artificial Sequence
  Antisense nucleotide
aataagatcaaataaa

SEQ ID NO: 1019 - DNA, 17 bp, Artificial Sequence
  Antisense nucleotide
taataagatcaaataaa

SEQ ID NO: 1020 - DNA, 18 bp, Artificial Sequence
  Antisense nucleotide
ttaataagatcaaataaa

SEQ ID NO: 1021 - DNA, 19 bp, Artificial Sequence
  Antisense nucleotide
tttaataagatcaaataaa

SEQ ID NO: 1022 - DNA, 14 bp, Artificial Sequence
  Antisense nucleotide
ttgtttaataagat

SEQ ID NO: 1023 - DNA, 15 bp, Artificial Sequence
  Antisense nucleotide
attgtttaataagat

SEQ ID NO: 1024 - DNA, 14 bp, Artificial Sequence
  Antisense nucleotide
tgattgtttaataa

SEQ ID NO: 1025 - DNA, 15 bp, Artificial Sequence
  Antisense nucleotide
ttgattgtttaataa

SEQ ID NO: 1026 - DNA, 16 bp, Artificial Sequence
  Antisense nucleotide
tttgattgtttaataa

SEQ ID NO: 1027 - DNA, 14 bp, Artificial Sequence
  Antisense nucleotide
ttttataaaacagt

SEQ ID NO: 1028 - DNA, 15 bp, Artificial Sequence
  Antisense nucleotide
tttttataaaacagt

SEQ ID NO: 1029 - DNA, 16 bp, Artificial Sequence
  Antisense nucleotide
ttttttataaaacagt

SEQ ID NO: 1030 - DNA, 15 bp, Artificial Sequence
  Antisense nucleotide
cttttttataaaaca

SEQ ID NO: 1031 - DNA, 16 bp, Artificial Sequence
  Antisense nucleotide
acttttttataaaaca

SEQ ID NO: 1032 - DNA, 15 bp, Artificial Sequence
  Antisense nucleotide
cacttttttataaaa

SEQ ID NO: 1033 - DNA, 16 bp, Artificial Sequence
  Antisense nucleotide
acacttttttataaaa

SEQ ID NO: 1034 - DNA, 17 bp, Artificial Sequence
  Antisense nucleotide
tacacttttttataaaa

SEQ ID NO: 1035 - DNA, 18 bp, Artificial Sequence
  Antisense nucleotide
atacacttttttataaaa

SEQ ID NO: 1036 - DNA, 14 bp, Artificial Sequence
  Antisense nucleotide
attttgaatttaag

SEQ ID NO: 1037 - DNA, 14 bp, Artificial Sequence
  Antisense nucleotide
gattttgaatttaa

SEQ ID NO: 1038 - DNA, 15 bp, Artificial Sequence
  Antisense nucleotide
tgattttgaatttaa

SEQ ID NO: 1039 - DNA, 16 bp, Artificial Sequence
  Antisense nucleotide
atgattttgaatttaa

SEQ ID NO: 1040 - DNA, 17 bp, Artificial Sequence
  Antisense nucleotide
aatgattttgaatttaa

SEQ ID NO: 1041 - DNA, 14 bp, Artificial Sequence
  Antisense nucleotide
ataatagaatcata

SEQ ID NO: 1042 - DNA, 15 bp, Artificial Sequence
  Antisense nucleotide
tataatagaatcata

SEQ ID NO: 1043 - DNA, 14 bp, Artificial Sequence
  Antisense nucleotide
tataatagaatcat

SEQ ID NO: 1044 - DNA, 14 bp, Artificial Sequence
  Antisense nucleotide
tactataatagaat

SEQ ID NO: 1045 - DNA, 15 bp, Artificial Sequence
  Antisense nucleotide
atactataatagaat

SEQ ID NO: 1046 - DNA, 16 bp, Artificial Sequence
  Antisense nucleotide
aatactataatagaat

SEQ ID NO: 1047 - DNA, 14 bp, Artificial Sequence
  Antisense nucleotide
agaatactataata

SEQ ID NO: 1048 - DNA, 15 bp, Artificial Sequence
  Antisense nucleotide
tagaatactataata

SEQ ID NO: 1049 - DNA, 16 bp, Artificial Sequence
  Antisense nucleotide
atagaatactataata

SEQ ID NO: 1050 - DNA, 17 bp, Artificial Sequence
  Antisense nucleotide
tatagaatactataata

SEQ ID NO: 1051 - DNA, 18 bp, Artificial Sequence
  Antisense nucleotide
ttatagaatactataata

SEQ ID NO: 1052 - DNA, 14 bp, Artificial Sequence
  Antisense nucleotide
aatatttgttttca

SEQ ID NO: 1053 - DNA, 15 bp, Artificial Sequence
  Antisense nucleotide
aaatatttgttttca

SEQ ID NO: 1054 - DNA, 16 bp, Artificial Sequence
  Antisense nucleotide
aaaatatttgttttca

SEQ ID NO: 1055 - DNA, 15 bp, Artificial Sequence
  Antisense nucleotide
caaaatatttgtttt

SEQ ID NO: 1056 - DNA, 14 bp, Artificial Sequence
  Antisense nucleotide
aaattttatatgga

SEQ ID NO: 1057 - DNA, 14 bp, Artificial Sequence
  Antisense nucleotide
tgaaattttatatg

SEQ ID NO: 1058 - DNA, 14 bp, Artificial Sequence
  Antisense nucleotide
ctgaaattttatat

SEQ ID NO: 1059 - DNA, 15 bp, Artificial Sequence
  Antisense nucleotide
tctgaaattttatat

SEQ ID NO: 1060 - DNA, 16 bp, Artificial Sequence
  Antisense nucleotide
ttctgaaattttatat

SEQ ID NO: 1061 - DNA, 14 bp, Artificial Sequence
  Antisense nucleotide
atctgatttatttt

SEQ ID NO: 1062 - DNA, 14 bp, Artificial Sequence
  Antisense nucleotide
aagatattaaatgt

SEQ ID NO: 1063 - DNA, 14 bp, Artificial Sequence
  Antisense nucleotide
tgaagatattaaat

SEQ ID NO: 1064 - DNA, 14 bp, Artificial Sequence
  Antisense nucleotide
ataaataacaatga

SEQ ID NO: 1065 - DNA, 15 bp, Artificial Sequence
  Antisense nucleotide
tataaataacaatga

SEQ ID NO: 1066 - DNA, 14 bp, Artificial Sequence
  Antisense nucleotide
gtataaataacaat

SEQ ID NO: 1067 - DNA, 15 bp, Artificial Sequence
  Antisense nucleotide
tgtataaataacaat

SEQ ID NO: 1068 - DNA, 16 bp, Artificial Sequence
  Antisense nucleotide
ttgtataaataacaat

SEQ ID NO: 1069 - DNA, 14 bp, Artificial Sequence
  Antisense nucleotide
tcttgtataaataa

SEQ ID NO: 1070 - DNA, 15 bp, Artificial Sequence
  Antisense nucleotide
atcttgtataaataa

SEQ ID NO: 1071 - DNA, 16 bp, Artificial Sequence
  Antisense nucleotide
aatcttgtataaataa

SEQ ID NO: 1072 - DNA, 14 bp, Artificial Sequence
  Antisense nucleotide
acaactttttaaat

SEQ ID NO: 1073 - DNA, 15 bp, Artificial Sequence
  Antisense nucleotide
tacaactttttaaat

SEQ ID NO: 1074 - DNA, 14 bp, Artificial Sequence
  Antisense nucleotide
tacaactttttaaa

SEQ ID NO: 1075 - DNA, 21 bp, Artificial Sequence
  Antisense nucleotide
cggggggttttgggcggcatg

SEQ ID NO: 1076 - DNA, 23 bp, Artificial Sequence
  Antisense nucleotide
ttttcggggggttttgggcggca

SEQ ID NO: 1077 - DNA, 19 bp, Artificial Sequence
  Antisense nucleotide
tcggggggttttgggcggc

SEQ ID NO: 1078 - DNA, 24 bp, Artificial Sequence
  Antisense nucleotide
ggtggcggccgtttttcggggggt

SEQ ID NO: 1079 - DNA, 23 bp, Artificial Sequence
  Antisense nucleotide
ccgggggttccgcggcggcagcg

SEQ ID NO: 1080 - DNA, 17 bp, Artificial Sequence
  Antisense nucleotide
cgggggttccgcggcgg

SEQ ID NO: 1081 - DNA, 23 bp, Artificial Sequence
  Antisense nucleotide
ggcggcggtgccgggggttccgc

SEQ ID NO: 1082 - DNA, 22 bp, Artificial Sequence
  Antisense nucleotide
ggagggggcggcggcggcggtg

SEQ ID NO: 1083 - DNA, 17 bp, Artificial Sequence
  Antisense nucleotide
gggggcggcggcggcgg

SEQ ID NO: 1084 - DNA, 15 bp, Artificial Sequence
  Antisense nucleotide
ggggcggcggcggcg

SEQ ID NO: 1085 - DNA, 17 bp, Artificial Sequence
  Antisense nucleotide
agggggcctggtggaag

SEQ ID NO: 1086 - DNA, 14 bp, Artificial
  Antisense nucleotide
tagggggcctggtg

SEQ ID NO: 1087 - DNA, 14 bp, Artificial Sequence
  Antisense nucleotide
gtagggggcctggt

SEQ ID NO: 1088 - DNA, 26 bp, Artificial Sequence
  Antisense nucleotide
gaggtattggtgacaaggtagggggc

SEQ ID NO: 1089 - DNA, 26 bp, Artificial Sequence
  Antisense nucleotide
tcttcaggggtgaaatatagatgttc

SEQ ID NO: 1090 - DNA, 16 bp, Artificial Sequence
  Antisense nucleotide
ggactcttcaggggtg

SEQ ID NO: 1091 - DNA, 14 bp, Artificial Sequence
  Antisense nucleotide
tcggactatactgc

SEQ ID NO: 1092 - DNA, 16 bp, Artificial Sequence
  Antisense nucleotide
cagttcggactatact

SEQ ID NO: 1093 - DNA, 14 bp, Artificial Sequence
  Antisense nucleotide
aagcctaagacgca

SEQ ID NO: 1094 - DNA, 14 bp, Artificial Sequence
  Antisense nucleotide
gcccaagttcaaca

SEQ ID NO: 1095 - DNA, 14 bp, Artificial Sequence
  Antisense nucleotide
tgaaaagtcgcggt

SEQ ID NO: 1096 - DNA, 18 bp, Artificial Sequence
  Antisense nucleotide
ggttaattaagatgcctc

SEQ ID NO: 1097 - DNA, 14 bp, Artificial Sequence
  Antisense nucleotide
tctctaagagcgca

SEQ ID NO: 1098 - DNA, 16 bp, Artificial Sequence
  Antisense nucleotide
acgtgaggttagtttg

SEQ ID NO: 1099 - DNA, 14 bp, Artificial Sequence
  Antisense nucleotide
cacgtgaggttagt

SEQ ID NO: 1100 - DNA, 14 bp, Artificial Sequence
  Antisense nucleotide
catagaacagtccg

SEQ ID NO: 1101 - DNA, 16 bp, Artificial Sequence
  Antisense nucleotide
cagtcatagaacagtc

SEQ ID NO: 1102 - DNA, 18 bp, Artificial Sequence
  Antisense nucleotide
ctttgcagtcatagaaca

SEQ ID NO: 1103 - DNA, 14 bp, Artificial Sequence
  Antisense nucleotide
tgcagtcatagaac

SEQ ID NO: 1104 - DNA, 14 bp, Artificial Sequence
  Antisense nucleotide
ggtcgtttccatct

SEQ ID NO: 1105 - DNA, 16 bp, Artificial Sequence
  Antisense nucleotide
catagaaggtcgtttc

SEQ ID NO: 1106 - DNA, 14 bp, Artificial Sequence
  Antisense nucleotide
cgtcatagaaggtc

SEQ ID NO: 1107 - DNA, 15 bp, Artificial Sequence
  Antisense nucleotide
catcgtcatagaagg

SEQ ID NO: 1108 - DNA, 24 bp, Artificial Sequence
  Antisense nucleotide
ggacgggaggaacgaggcgttgag

SEQ ID NO: 1109 - DNA, 14 bp, Artificial Sequence
  Antisense nucleotide
tagccataaggtcc

SEQ ID NO: 1110 - DNA, 14 bp, Artificial Sequence
  Antisense nucleotide
ggttactgtagcca

SEQ ID NO: 1111 - DNA, 14 bp, Artificial Sequence
  Antisense nucleotide
ggttactgtagcca

SEQ ID NO: 1112 - DNA, 18 bp, Artificial Sequence
  Antisense nucleotide
agttcttggcgcggaggt

SEQ ID NO: 1113 - DNA, 18 bp, Artificial Sequence
  Antisense nucleotide
aggtgaggaggtccgagt

SEQ ID NO: 1114 - DNA, 16 bp, Artificial Sequence
  Antisense nucleotide
tggactggattatcag

SEQ ID NO: 1115 - DNA, 18 bp, Artificial Sequence
  Antisense nucleotide
gtggtggtgatgtgcccg

SEQ ID NO: 1116 - DNA, 14 bp, Artificial Sequence
  Antisense nucleotide
tgtcacgttcttgg

SEQ ID NO: 1117 - DNA, 14 bp, Artificial Sequence
  Antisense nucleotide
ctcatctgtcacgt

SEQ ID NO: 1118 - DNA, 18 bp, Artificial Sequence
  Antisense nucleotide
cgaagccctcggcgaacc

SEQ ID NO: 1119 - DNA, 24 bp, Artificial Sequence
  Antisense nucleotide
gcgtgttctggctgtgcagttcgg

SEQ ID NO: 1120 - DNA, 14 bp, Artificial Sequence
  Antisense nucleotide
ctgccccgttgacc

SEQ ID NO: 1121 - DNA, 14 bp, Artificial Sequence
  Antisense nucleotide
aggtttgcgtagac

SEQ ID NO: 1122 - DNA, 14 bp, Artificial Sequence
  Antisense nucleotide
ggttgaagttgctg

SEQ ID NO: 1123 - DNA, 14 bp, Artificial Sequence
  Antisense nucleotide
ctgggttgaagttg

SEQ ID NO: 1124 - DNA, 20 bp, Artificial Sequence
  Antisense nucleotide
tgctgcacgggcatctgctg

SEQ ID NO: 1125 - DNA, 27 bp, Artificial Sequence
  Antisense nucleotide
ggcactgtctgaggctcctccttcagg

SEQ ID NO: 1126 - DNA, 14 bp, Artificial Sequence
  Antisense nucleotide
actccatgtcgatg

SEQ ID NO: 1127 - DNA, 16 bp, Artificial Sequence
  Antisense nucleotide
ctctccgccttgatcc

SEQ ID NO: 1128 - DNA, 16 bp, Artificial Sequence
  Antisense nucleotide
gttcctcatgcgcttc

SEQ ID NO: 1129 - DNA, 14 bp, Artificial Sequence
  Antisense nucleotide
ctgagctttcaagg

SEQ ID NO: 1130 - DNA, 26 bp, Artificial Sequence
  Antisense nucleotide
gcgattctctccagcttcctttttcg

SEQ ID NO: 1131 - DNA, 30 bp, Artificial Sequence
  Antisense nucleotide
ctgagctttcaaggttttcactttttcctc

SEQ ID NO: 1132 - DNA, 14 bp, Artificial Sequence
  Antisense nucleotide
tccctgagcatgtt

SEQ ID NO: 1133 - DNA, 16 bp, Artificial Sequence
  Antisense nucleotide
tctgtttaagctgtgc

SEQ ID NO: 1134 - DNA, 18 bp, Artificial Sequence
  Antisense nucleotide
ctttctgtttaagctgtg

SEQ ID NO: 1135 - DNA, 16 bp, Artificial Sequence
  Antisense nucleotide
ggttcatgactttctg

SEQ ID NO: 1136 - DNA, 14 bp, Artificial Sequence
  Antisense nucleotide
cgtggttcatgact

SEQ ID NO: 1137 - DNA, 16 bp, Artificial Sequence
  Antisense nucleotide
actgttaacgtggttc

SEQ ID NO: 1138 - DNA, 14 bp, Artificial Sequence
  Antisense nucleotide
ccactgttaacgtg

SEQ ID NO: 1139 - DNA, 14 bp, Artificial Sequence
  Antisense nucleotide
cccactgttaacgt

SEQ ID NO: 1140 - DNA, 14 bp, Artificial Sequence
  Antisense nucleotide
agcatgagttggca

SEQ ID NO: 1141 - DNA, 14 bp, Artificial Sequence
  Antisense nucleotide
gcgttagcatgagt

SEQ ID NO: 1142 - DNA, 14 bp, Artificial Sequence
  Antisense nucleotide
gtttgcaactgctg

SEQ ID NO: 1143 - DNA, 18 bp, Artificial Sequence
  Antisense nucleotide
caaaatgtttgcaactgc

SEQ ID NO: 1144 - DNA, 18 bp, Artificial Sequence
  Antisense nucleotide
tccattttagtgcacatc

SEQ ID NO: 1145 - DNA, 18 bp, Artificial Sequence
  Antisense nucleotide
ctgttccattttagtgca

SEQ ID NO: 1146 - DNA, 14 bp, Artificial Sequence
  Antisense nucleotide
gtgtatgagtcgtc

SEQ ID NO: 1147 - DNA, 14 bp, Artificial Sequence
  Antisense nucleotide
ctgtgtatgagtcg

SEQ ID NO: 1148 - DNA, 14 bp, Artificial Sequence
  Antisense nucleotide
cgtagctgtgtatg

SEQ ID NO: 1149 - DNA, 14 bp, Artificial Sequence
  Antisense nucleotide
tcgtgtagagagag

SEQ ID NO: 1150 - DNA, 18 bp, Artificial Sequence
  Antisense nucleotide
agtttgtagtcgtgtaga

SEQ ID NO: 1151 - DNA, 16 bp, Artificial Sequence
  Antisense nucleotide
gtttgtagtcgtgtag

SEQ ID NO: 1152 - DNA, 14 bp, Artificial Sequence
  Antisense nucleotide
agtttgtagtcgtg

SEQ ID NO: 1153 - DNA, 14 bp, Artificial Sequence
  Antisense nucleotide
ggagtttgtagtcg

SEQ ID NO: 1154 - DNA, 16 bp, Artificial Sequence
  Antisense nucleotide
tcaggagtttgtagtc

SEQ ID NO: 1155 - DNA, 18 bp, Artificial Sequence
  Antisense nucleotide
gtttcaggagtttgtagt

SEQ ID NO: 1156 - DNA, 14 bp, Artificial Sequence
  Antisense nucleotide
tcggtttcaggagt

SEQ ID NO: 1157 - DNA, 14 bp, Artificial Sequence
  Antisense nucleotide
ttgagactccggta

SEQ ID NO: 1158 - DNA, 16 bp, Artificial Sequence
  Antisense nucleotide
accagaaaagtagctg

SEQ ID NO: 1159 - DNA, 14 bp, Artificial Sequence
  Antisense nucleotide
cctgaccagaaaag

SEQ ID NO: 1160 - DNA, 14 bp, Artificial Sequence
  Antisense nucleotide
attcaggcgttcca

SEQ ID NO: 1161 - DNA, 16 bp, Artificial Sequence
  Antisense nucleotide
ggtaaaagtactgtcc

SEQ ID NO: 1162 - DNA, 16 bp, Artificial Sequence
  Antisense nucleotide
gggtaaaagtactgtc

SEQ ID NO: 1163 - DNA, 18 bp, Artificial Sequence
  Antisense nucleotide
gcacctccaccgctgcca

SEQ ID NO: 1164 - DNA, 18 bp, Artificial Sequence
  Antisense nucleotide
ctcctgctcctcggtgac

SEQ ID NO: 1165 - DNA, 14 bp, Artificial Sequence
  Antisense nucleotide
gctttgacaaagcc

SEQ ID NO: 1166 - DNA, 14 bp, Artificial Sequence
  Antisense nucleotide
cttgtgcagatcgt

SEQ ID NO: 1167 - DNA, 16 bp, Artificial Sequence
  Antisense nucleotide
tcatcttgtgcagatc

SEQ ID NO: 1168 - DNA, 16 bp, Artificial Sequence
  Antisense nucleotide
gttcatcttgtgcaga

SEQ ID NO: 1169 - DNA, 14 bp, Artificial Sequence
  Antisense nucleotide
cgtggttcatcttg

SEQ ID NO: 1170 - DNA, 14 bp, Artificial Sequence
  Antisense nucleotide
tcacgtggttcatc

SEQ ID NO: 1171 - DNA, 14 bp, Artificial Sequence
  Antisense nucleotide
ggttggtgtaaacg

SEQ ID NO: 1172 - DNA, 20 bp, Artificial Sequence
  Antisense nucleotide
tacgagctcccggtcccgac

SEQ ID NO: 1173 - DNA, 14 bp, Artificial Sequence
  Antisense nucleotide
tagctgatggtggt

SEQ ID NO: 1174 - DNA, 14 bp, Artificial Sequence
  Antisense nucleotide
tccttgaaggtgga

SEQ ID NO: 1175 - DNA, 16 bp, Artificial Sequence
  Antisense nucleotide
tcttccatgttgatgg

SEQ ID NO: 1176 - DNA, 14 bp, Artificial Sequence
  Antisense nucleotide
ctttgatgcgctct

SEQ ID NO: 1177 - DNA, 14 bp, Artificial Sequence
  Antisense nucleotide
ctccactttgatgc

SEQ ID NO: 1178 - DNA, 30 bp, Artificial Sequence
  Antisense nucleotide
gctccagcttccgcttccggcacttggtgg

SEQ ID NO: 1179 - DNA, 30 bp, Artificial Sequence
  Antisense nucleotide
ggccttgagcgtcttcaccttgtcctccag

SEQ ID NO: 1180 - DNA, 16 bp, Artificial Sequence
  Antisense nucleotide
tgaccttctgtttgag

SEQ ID NO: 1181 - DNA, 16 bp, Artificial Sequence
  Antisense nucleotide
catgaccttctgtttg

SEQ ID NO: 1182 - DNA, 14 bp, Artificial Sequence
  Antisense nucleotide
gtcatgaccttctg

SEQ ID NO: 1183 - DNA, 14 bp, Artificial Sequence
  Antisense nucleotide
cgagaacatcatcg

SEQ ID NO: 1184 - DNA, 14 bp, Artificial Sequence
  Antisense nucleotide
gtagtctgcgttga

SEQ ID NO: 1185 - DNA, 20 bp, Artificial Sequence
  Antisense nucleotide
gctgcagcgggaggatgacg

SEQ ID NO: 1186 - DNA, 16 bp, Artificial Sequence
  Antisense nucleotide
agtaagagaggctatc

SEQ ID NO: 1187 - DNA, 14 bp, Artificial Sequence
  Antisense nucleotide
gtagtaagagaggc

SEQ ID NO: 1188 - DNA, 14 bp, Artificial Sequence
  Antisense nucleotide
ggtagtaagagagg

SEQ ID NO: 1189 - DNA, 16 bp, Artificial Sequence
  Antisense nucleotide
gtgagtggtagtaaga

SEQ ID NO: 1190 - DNA, 18 bp, Artificial Sequence
  Antisense nucleotide
gtccgtgcagaagtcctg

SEQ ID NO: 1191 - DNA, 16 bp, Artificial Sequence
  Antisense nucleotide
gaatgaagttggcact

SEQ ID NO: 1192 - DNA, 14 bp, Artificial Sequence
  Antisense nucleotide
ggaatgaagttggc

SEQ ID NO: 1193 - DNA, 14 bp, Artificial Sequence
  Antisense nucleotide
gggaatgaagttgg

SEQ ID NO: 1194 - DNA, 30 bp, Artificial Sequence
  Antisense nucleotide
gctgcaccagccactgcaggtccggactgg

SEQ ID NO: 1195 - DNA, 16 bp, Artificial Sequence
  Antisense nucleotide
tcatggtcttcacaac

SEQ ID NO: 1196 - DNA, 30 bp, Artificial Sequence
  Antisense nucleotide
caatgctctgcgctcggcctcctgtcatgg

SEQ ID NO: 1197 - DNA, 14 bp, Artificial Sequence
  Antisense nucleotide
ctagagttcctcac

SEQ ID NO: 1198 - DNA, 14 bp, Artificial Sequence
  Antisense nucleotide
gagtacgctagagt

SEQ ID NO: 1199 - DNA, 14 bp, Artificial Sequence
  Antisense nucleotide
gaagagtacgctag

SEQ ID NO: 1200 - DNA, 28 bp, Artificial Sequence
  Antisense nucleotide
ctgcttcccacccagcccccacattccc

SEQ ID NO: 1201 - DNA, 20 bp, Artificial Sequence
  Antisense nucleotide
ttcatcctctgtactgggct

SEQ ID NO: 1202 - DNA, 14 bp, Artificial Sequence
  Antisense nucleotide
gttacggatgtgca

SEQ ID NO: 1203 - DNA, 14 bp, Artificial Sequence
  Antisense nucleotide
cagttacggatgtg

SEQ ID NO: 1204 - DNA, 14 bp, Artificial Sequence
  Antisense nucleotide
ccagttacggatgt

SEQ ID NO: 1205 - DNA, 14 bp, Artificial Sequence
  Antisense nucleotide
agagtctgagttgg

SEQ ID NO: 1206 - DNA, 14 bp, Artificial Sequence
  Antisense nucleotide
gtgagactcagagt

SEQ ID NO: 1207 - DNA, 14 bp, Artificial Sequence
  Antisense nucleotide
tcttagggtgagac

SEQ ID NO: 1208 - DNA, 16 bp, Artificial Sequence
  Antisense nucleotide
gagagtacttcttagg

SEQ ID NO: 1209 - DNA, 18 bp, Artificial Sequence
  Antisense nucleotide
ggaagaaactatgagagt

SEQ ID NO: 1210 - DNA, 18 bp, Artificial Sequence
  Antisense nucleotide
cttagggaagaaactatg

SEQ ID NO: 1211 - DNA, 16 bp, Artificial Sequence
  Antisense nucleotide
cggtaagaaacttagg

SEQ ID NO: 1212 - DNA, 14 bp, Artificial Sequence
  Antisense nucleotide
agcatgcggtaaga

SEQ ID NO: 1213 - DNA, 14 bp, Artificial Sequence
  Antisense nucleotide
gtctgaaagcatgc

SEQ ID NO: 1214 - DNA, 16 bp, Artificial Sequence
  Antisense nucleotide
agaacaaagaagagcc

SEQ ID NO: 1215 - DNA, 18 bp, Artificial Sequence
  Antisense nucleotide
caagagaacaaagaagag

SEQ ID NO: 1216 - DNA, 16 bp, Artificial Sequence
  Antisense nucleotide
cagcaagagaacaaag

SEQ ID NO: 1217 - DNA, 14 bp, Artificial Sequence
  Antisense nucleotide
tcctcagcaagaga

SEQ ID NO: 1218 - DNA, 14 bp, Artificial Sequence
  Antisense nucleotide
aggtgtgacttgca

SEQ ID NO: 1219 - DNA, 16 bp, Artificial
  Antisense nucleotide
gaataggtgtgacttg

SEQ ID NO: 1220 - DNA, 16 bp, Artificial Sequence
  Antisense nucleotide
cagaataggtgtgact

SEQ ID NO: 1221 - DNA, 14 bp, Artificial Sequence
  Antisense nucleotide
gcagaataggtgtg

SEQ ID NO: 1222 - DNA, 16 bp, Artificial Sequence
  Antisense nucleotide
cagttgcagaataggt

SEQ ID NO: 1223 - DNA, 16 bp, Artificial Sequence
  Antisense nucleotide
gaaaccatttctgacc

SEQ ID NO: 1224 - DNA, 18 bp, Artificial Sequence
  Antisense nucleotide
tgtgaaaccatttctgac

SEQ ID NO: 1225 - DNA, 18 bp, Artificial Sequence
  Antisense nucleotide
cactgtgaaaccatttct

SEQ ID NO: 1226 - DNA, 14 bp, Artificial Sequence
  Antisense nucleotide
ccactgtgaaacca

SEQ ID NO: 1227 - DNA, 30 bp, Artificial Sequence
  Antisense nucleotide
agaactggctcctgcagcttccctgcttcc

SEQ ID NO: 1228 - DNA, 15 bp, Artificial Sequence
  Antisense nucleotide
cacctccattcaccc

SEQ ID NO: 1229 - DNA, 16 bp, Artificial Sequence
  Antisense nucleotide
cagtaaaagtgtctgc

SEQ ID NO: 1230 - DNA, 18 bp, Artificial Sequence
  Antisense nucleotide
cgacattcagtaaaagtg

SEQ ID NO: 1231 - DNA, 14 bp, Artificial Sequence
  Antisense nucleotide
gaccgacattcagt

SEQ ID NO: 1232 - DNA, 18 bp, Artificial Sequence
  Antisense nucleotide
cttctggagataactaga

SEQ ID NO: 1233 - DNA, 18 bp, Artificial Sequence
  Antisense nucleotide
catcttattcctttccct

SEQ ID NO: 1234 - DNA, 16 bp, Artificial Sequence
  Antisense nucleotide
cagccatcttattcct

SEQ ID NO: 1235 - DNA, 16 bp, Artificial Sequence
  Antisense nucleotide
tgcagccatcttattc

SEQ ID NO: 1236 - DNA, 15 bp, Artificial Sequence
  Antisense nucleotide
gagtgtatcagtcag

SEQ ID NO: 1237 - DNA, 14 bp, Artificial Sequence
  Antisense nucleotide
ggagtgtatcagtc

SEQ ID NO: 1238 - DNA, 16 bp, Artificial Sequence
  Antisense nucleotide
cttggagtgtatcagt

SEQ ID NO: 1239 - DNA, 14 bp, Artificial Sequence
  Antisense nucleotide
acagagtacctacc

SEQ ID NO: 1240 - DNA, 16 bp, Artificial Sequence
  Antisense nucleotide
ccaactttcccttaag

SEQ ID NO: 1241 - DNA, 16 bp, Artificial Sequence
  Antisense nucleotide
ccttatgctcaatctc

SEQ ID NO: 1242 - DNA, 14 bp, Artificial Sequence
  Antisense nucleotide
gtcttactcaaggg

SEQ ID NO: 1243 - DNA, 16 bp, Artificial Sequence
  Antisense nucleotide
acagtcttactcaagg

SEQ ID NO: 1244 - DNA, 18 bp, Artificial Sequence
  Antisense nucleotide
cataagacacagtcttac

SEQ ID NO: 1245 - DNA, 18 bp, Artificial Sequence
  Antisense nucleotide
gaaagcataagacacagt

SEQ ID NO: 1246 - DNA, 16 bp, Artificial Sequence
  Antisense nucleotide
ggaaagcataagacac

SEQ ID NO: 1247 - DNA, 16 bp, Artificial Sequence
  Antisense nucleotide
agggataaaggaaagc

SEQ ID NO: 1248 - DNA, 14 bp, Artificial Sequence
  Antisense nucleotide
cctgtatacagagg

SEQ ID NO: 1249 - DNA, 16 bp, Artificial Sequence
  Antisense nucleotide
tgtctcctgtatacag

SEQ ID NO: 1250 - DNA, 16 bp, Artificial Sequence
  Antisense nucleotide
catcttctagttggtc

SEQ ID NO: 1251 - DNA, 16 bp, Artificial Sequence
  Antisense nucleotide
ctcatcttctagttgg

SEQ ID NO: 1252 - DNA, 18 bp, Artificial Sequence
  Antisense nucleotide
cttctcatcttctagttg

SEQ ID NO: 1253 - DNA, 16 bp, Artificial Sequence
  Antisense nucleotide
caaagcagacttctca

SEQ ID NO: 1254 - DNA, 14 bp, Artificial Sequence
  Antisense nucleotide
ctgcaaagcagact

SEQ ID NO: 1255 - DNA, 18 bp, Artificial Sequence
  Antisense nucleotide
ctagtttttccttctcct

SEQ ID NO: 1256 - DNA, 18 bp, Artificial Sequence
  Antisense nucleotide
tctagtttttccttctcc

SEQ ID NO: 1257 - DNA, 16 bp, Artificial Sequence
  Antisense nucleotide
caggatgaactctagt

SEQ ID NO: 1258 - DNA, 14 bp, Artificial Sequence
  Antisense nucleotide
tcgtagaaggtcgt

SEQ ID NO: 1259 - DNA, 14 bp, Artificial Sequence
  Antisense nucleotide
agggttactgtagc

SEQ ID NO: 1260 - DNA, 14 bp, Artificial Sequence
  Antisense nucleotide
gtagtggtgatgtg

SEQ ID NO: 1261 - DNA, 14 bp, Artificial Sequence
  Antisense nucleotide
cgtcgtagaaggtc

SEQ ID NO: 1262 - DNA, 14 bp, Artificial Sequence
  Antisense nucleotide
tttcgtgcacatcc

SEQ ID NO: 1263 - DNA, 18 bp, Artificial Sequence
  Antisense nucleotide
agtttgtagtcgtgaaga

SEQ ID NO: 1264 - DNA, 14 bp, Artificial Sequence
  Antisense nucleotide
cgagaacatcatgg

SEQ ID NO: 1265 - DNA, 14 bp, Artificial Sequence
  Antisense nucleotide
gtagtaggaaaggc

SEQ ID NO: 1266 - DNA, 14 bp, Artificial Sequence
  Antisense nucleotide
ggtagtaggaaagg

SEQ ID NO: 1267 - DNA, 14 bp, Artificial Sequence
  Antisense nucleotide
ggaatggtagtagg

SEQ ID NO: 1268 - DNA, 15 bp, Artificial Sequence
  Antisense nucleotide
ggtcattgagaagag

SEQ ID NO: 1269 - DNA, 16 bp, Artificial Sequence
  Antisense nucleotide
gctaatgttcttgacc

SEQ ID NO: 1270 - DNA, 14 bp, Artificial Sequence
  Antisense nucleotide
gccaaggtcctcat

SEQ ID NO: 1271 - DNA, 14 bp, Artificial Sequence
  Antisense nucleotide
ggagtctatctcca

SEQ ID NO: 1272 - DNA, 16 bp, Artificial Sequence
  Antisense nucleotide
ccaaagaatcctgact

SEQ ID NO: 1273 - DNA, 14 bp, Artificial Sequence
  Antisense nucleotide
cacatgcttagtgg

SEQ ID NO: 1274 - DNA, 14 bp, Artificial Sequence
  Antisense nucleotide
ctcgtaaatgaccg

SEQ ID NO: 1275 - DNA, 18 bp, Artificial Sequence
  Antisense nucleotide
aggaatctcgtaaatgac

SEQ ID NO: 1276 - DNA, 14 bp, Artificial Sequence
  Antisense nucleotide
cagcagcgattcat

SEQ ID NO: 1277 - DNA, 16 bp, Artificial Sequence
  Antisense nucleotide
ggagatcatcaaagga

SEQ ID NO: 1278 - DNA, 14 bp, Artificial Sequence
  Antisense nucleotide
ctcagcaatggtca

SEQ ID NO: 1279 - DNA, 14 bp, Artificial Sequence
  Antisense nucleotide
gatctcgaacacct

SEQ ID NO: 1280 - DNA, 18 bp, Artificial Sequence
  Antisense nucleotide
cacaatctcgatctttct

SEQ ID NO: 1281 - DNA, 18 bp, Artificial Sequence
  Antisense nucleotide
ccttcttaaagattggct

SEQ ID NO: 1282 - DNA, 14 bp, Artificial Sequence
  Antisense nucleotide
cacataccaactgg

SEQ ID NO: 1283 - DNA, 14 bp, Artificial Sequence
  Antisense nucleotide
agcttgatgtgagg

SEQ ID NO: 1284 - DNA, 18 bp, Artificial Sequence
  Antisense nucleotide
gaagttgtagcttgatgt

SEQ ID NO: 1285 - DNA, 16 bp, Artificial Sequence
  Antisense nucleotide
gcttgaagttgtagct

SEQ ID NO: 1286 - DNA, 16 bp, Artificial Sequence
  Antisense nucleotide
ctgcttgaagttgtag

SEQ ID NO: 1287 - DNA, 14 bp, Artificial Sequence
  Antisense nucleotide
gacacaactcctct

SEQ ID NO: 1288 - DNA, 18 bp, Artificial Sequence
  Antisense nucleotide
tcctttgatagacacaac

SEQ ID NO: 1289 - DNA, 16 bp, Artificial Sequence
  Antisense nucleotide
ctcgtttgatagacac

SEQ ID NO: 1290 - DNA, 14 bp, Artificial Sequence
  Antisense nucleotide
ggttagcacacact

SEQ ID NO: 1291 - DNA, 14 bp, Artificial Sequence
  Antisense nucleotide
ggtaacggttagca

SEQ ID NO: 1292 - DNA, 18 bp, Artificial Sequence
  Antisense nucleotide
cgtaacacatttagaagc

SEQ ID NO: 1293 - DNA, 14 bp, Artificial Sequence
  Antisense nucleotide
ctcatccgtaacac

SEQ ID NO: 1294 - DNA, 18 bp, Artificial Sequence
  Antisense nucleotide
ccggtaagtattgtagtt

SEQ ID NO: 1295 - DNA, 16 bp, Artificial Sequence
  Antisense nucleotide
ggtgtatttccttgac

SEQ ID NO: 1296 - DNA, 16 bp, Artificial Sequence
  Antisense nucleotide
acataccaactggtgt

SEQ ID NO: 1297 - DNA, 14 bp, Artificial Sequence
  Antisense nucleotide
gtccctatacgaac

SEQ ID NO: 1298 - DNA, 14 bp, Artificial Sequence
  Antisense nucleotide
ttcatgtctgtgcc

SEQ ID NO: 1299 - DNA, 14 bp, Artificial Sequence
  Antisense nucleotide
gtaggtgagttcca

SEQ ID NO: 1300 - DNA, 14 bp, Artificial Sequence
  Antisense nucleotide
gttgtgagcgatga

SEQ ID NO: 1301 - DNA, 18 bp, Artificial Sequence
  Antisense nucleotide
catagttgtcctcaaaga

SEQ ID NO: 1302 - DNA, 14 bp, Artificial Sequence
  Antisense nucleotide
ggcatagttgtcct

SEQ ID NO: 1303 - DNA, 14 bp, Artificial Sequence
  Antisense nucleotide
cattgtctagcacg

SEQ ID NO: 1304 - DNA, 14 bp, Artificial Sequence
  Antisense nucleotide
ctccattgtctagc

SEQ ID NO: 1305 - DNA, 14 bp, Artificial Sequence
  Antisense nucleotide
gtattgttcagcgg

SEQ ID NO: 1306 - DNA, 16 bp, Artificial Sequence
  Antisense nucleotide
tcaagatctctgtgag

SEQ ID NO: 1307 - DNA, 16 bp, Artificial Sequence
  Antisense nucleotide
cacaaaatcgtgtcct

SEQ ID NO: 1308 - DNA, 16 bp, Artificial Sequence
  Antisense nucleotide
tccttccacaaaatcg

SEQ ID NO: 1309 - DNA, 14 bp, Artificial Sequence
  Antisense nucleotide
gtggaagatgtcct

SEQ ID NO: 1310 - DNA, 16 bp, Artificial Sequence
  Antisense nucleotide
tcttgtggaagatgtc

SEQ ID NO: 1311 - DNA, 16 bp, Artificial Sequence
  Antisense nucleotide
tctatcagtgtgagag

SEQ ID NO: 1312 - DNA, 14 bp, Artificial Sequence
  Antisense nucleotide
ggttggtgtctatc

SEQ ID NO: 1313 - DNA, 14 bp, Artificial Sequence
  Antisense nucleotide
acatcggagaacag

SEQ ID NO: 1314 - DNA, 14 bp, Artificial Sequence
  Antisense nucleotide
ccttacacatcgga

SEQ ID NO: 1315 - DNA, 16 bp, Artificial Sequence
  Antisense nucleotide
acaatcctcagaactc

SEQ ID NO: 1316 - DNA, 14 bp, Artificial Sequence
  Antisense nucleotide
gctctgacaatcct

SEQ ID NO: 1317 - DNA, 14 bp, Artificial Sequence
  Antisense nucleotide
tggttgaagtggag

SEQ ID NO: 1318 - DNA, 14 bp, Artificial Sequence
  Antisense nucleotide
ctgtggttgaagtg

SEQ ID NO: 1319 - DNA, 14 bp, Artificial Sequence
  Antisense nucleotide
gttgtaggtgacca

SEQ ID NO: 1320 - DNA, 14 bp, Artificial Sequence
  Antisense nucleotide
ctgtgttgtaggtg

SEQ ID NO: 1321 - DNA, 14 bp, Artificial Sequence
  Antisense nucleotide
gactcaaacgtgtc

SEQ ID NO: 1322 - DNA, 14 bp, Artificial Sequence
  Antisense nucleotide
catggactcaaacg

SEQ ID NO: 1323 - DNA, 14 bp, Artificial Sequence
  Antisense nucleotide
cgaatgtataccgg

SEQ ID NO: 1324 - DNA, 14 bp, Artificial Sequence
  Antisense nucleotide
ccgaatgtataccg

SEQ ID NO: 1325 - DNA, 14 bp, Artificial Sequence
  Antisense nucleotide
gccgaatgtatacc

SEQ ID NO: 1326 - DNA, 14 bp, Artificial Sequence
  Antisense nucleotide
gtagttgtagggac

SEQ ID NO: 1327 - DNA, 18 bp, Artificial Sequence
  Antisense nucleotide
tagaaaggtagttgtagg

SEQ ID NO: 1328 - DNA, 18 bp, Artificial Sequence
  Antisense nucleotide
gtagaaaggtagttgtag

SEQ ID NO: 1329 - DNA, 16 bp, Artificial Sequence
  Antisense nucleotide
cgtagaaaggtagttg

SEQ ID NO: 1330 - DNA, 14 bp, Artificial Sequence
  Antisense nucleotide
ccgtagaaaggtag

SEQ ID NO: 1331 - DNA, 14 bp, Artificial Sequence
  Antisense nucleotide
gaccatagcacact

SEQ ID NO: 1332 - DNA, 14 bp, Artificial Sequence
  Antisense nucleotide
ggatattggcactg

SEQ ID NO: 1333 - DNA, 14 bp, Artificial Sequence
  Antisense nucleotide
cctggatattggca

SEQ ID NO: 1334 - DNA, 14 bp, Artificial Sequence
  Antisense nucleotide
gctcccaaagatct

SEQ ID NO: 1335 - DNA, 14 bp, Artificial Sequence
  Antisense nucleotide
cccatcaaagctct

SEQ ID NO: 1336 - DNA, 14 bp, Artificial Sequence
  Antisense nucleotide
caaacacttggagc

SEQ ID NO: 1337 - DNA, 16 bp, Artificial Sequence
  Antisense nucleotide
gtctcaaacacttgga

SEQ ID NO: 1338 - DNA, 16 bp, Artificial Sequence
  Antisense nucleotide
gagtctcaaacacttg

SEQ ID NO: 1339 - DNA, 16 bp, Artificial Sequence
  Antisense nucleotide
gtaacctgtgatctct

SEQ ID NO: 1340 - DNA, 14 bp, Artificial Sequence
  Antisense nucleotide
ggtaacctgtgatc

SEQ ID NO: 1341 - DNA, 16 bp, Artificial Sequence
  Antisense nucleotide
gtataggtaacctgtg

SEQ ID NO: 1342 - DNA, 18 bp, Artificial Sequence
  Antisense nucleotide
tgagatgtataggtaacc

SEQ ID NO: 1343 - DNA, 16 bp, Artificial Sequence
  Antisense nucleotide
tgctgagatgtatagg

SEQ ID NO: 1344 - DNA, 14 bp, Artificial Sequence
  Antisense nucleotide
ccatgctgagatgt

SEQ ID NO: 1345 - DNA, 14 bp, Artificial Sequence
  Antisense nucleotide
ggattacttgcagg

SEQ ID NO: 1346 - DNA, 16 bp, Artificial Sequence
  Antisense nucleotide
tgttatggtggatgag

SEQ ID NO: 1347 - DNA, 14 bp, Artificial Sequence
  Antisense nucleotide
ggtgttatggtgga

SEQ ID NO: 1348 - DNA, 14 bp, Artificial Sequence
  Antisense nucleotide
gcagttgacacact

SEQ ID NO: 1349 - DNA, 14 bp, Artificial Sequence
  Antisense nucleotide
agtactcggcattc

SEQ ID NO: 1350 - DNA, 16 bp, Artificial Sequence
  Antisense nucleotide
cattcacatactccct

SEQ ID NO: 1351 - DNA, 16 bp, Artificial Sequence
  Antisense nucleotide
tccaaaacaggtcact

SEQ ID NO: 1352 - DNA, 14 bp, Artificial Sequence
  Antisense nucleotide
ggtccttatagtgg

SEQ ID NO: 1353 - DNA, 14 bp, Artificial Sequence
  Antisense nucleotide
cagaatgccaacca

SEQ ID NO: 1354 - DNA, 14 bp, Artificial Sequence
  Antisense nucleotide
acgagaatgccaac

SEQ ID NO: 1355 - DNA, 14 bp, Artificial Sequence
  Antisense nucleotide
gatcccaaagacca

SEQ ID NO: 1356 - DNA, 14 bp, Artificial Sequence
  Antisense nucleotide
tcgcttgatgagga

SEQ ID NO: 1357 - DNA, 14 bp, Artificial Sequence
  Antisense nucleotide
catcgtgtacttcc

SEQ ID NO: 1358 - DNA, 14 bp, Artificial Sequence
  Antisense nucleotide
gcatcgtgtacttc

SEQ ID NO: 1359 - DNA, 14 bp, Artificial Sequence
  Antisense nucleotide
actgtgccaaaagc

SEQ ID NO: 1360 - DNA, 14 bp, Artificial Sequence
  Antisense nucleotide
cttgtagactgtgc

SEQ ID NO: 1361 - DNA, 14 bp, Artificial Sequence
  Antisense nucleotide
cccttgtagactgt

SEQ ID NO: 1362 - DNA, 16 bp, Artificial Sequence
  Antisense nucleotide
tcaacactttgatggc

SEQ ID NO: 1363 - DNA, 14 bp, Artificial Sequence
  Antisense nucleotide
ccctcaacactttg

SEQ ID NO: 1364 - DNA, 16 bp, Artificial Sequence
  Antisense nucleotide
gtgttttccctcaaca

SEQ ID NO: 1365 - DNA, 16 bp, Artificial Sequence
  Antisense nucleotide
gtatgcttcgtctaag

SEQ ID NO: 1366 - DNA, 14 bp, Artificial Sequence
  Antisense nucleotide
cgtatgcttcgtct

SEQ ID NO: 1367 - DNA, 14 bp, Artificial Sequence
  Antisense nucleotide
ccatcacgtatgct

SEQ ID NO: 1368 - DNA, 14 bp, Artificial Sequence
  Antisense nucleotide
gcataagctgtgtc

SEQ ID NO: 1369 - DNA, 14 bp, Artificial Sequence
  Antisense nucleotide
catggtctaagagg

SEQ ID NO: 1370 - DNA, 16 bp, Artificial Sequence
  Antisense nucleotide
caatctgcatacacca

SEQ ID NO: 1371 - DNA, 14 bp, Artificial Sequence
  Antisense nucleotide
ggcaatctgcatac

SEQ ID NO: 1372 - DNA, 14 bp, Artificial Sequence
  Antisense nucleotide
ctgtctcgtcaatg

SEQ ID NO: 1373 - DNA, 16 bp, Artificial Sequence
  Antisense nucleotide
cataactccacacatc

SEQ ID NO: 1374 - DNA, 16 bp, Artificial Sequence
  Antisense nucleotide
agtcacaccataactc

SEQ ID NO: 1375 - DNA, 16 bp, Artificial Sequence
  Antisense nucleotide
acagtcacaccataac

SEQ ID NO: 1376 - DNA, 14 bp, Artificial Sequence
  Antisense nucleotide
ccccaaaagtcatc

SEQ ID NO: 1377 - DNA, 14 bp, Artificial Sequence
  Antisense nucleotide
tcgtaaggtttggc

SEQ ID NO: 1378 - DNA, 14 bp, Artificial Sequence
  Antisense nucleotide
gatcccatcgtaag

SEQ ID NO: 1379 - DNA, 14 bp, Artificial Sequence
  Antisense nucleotide
caatggtgcagatg

SEQ ID NO: 1380 - DNA, 14 bp, Artificial Sequence
  Antisense nucleotide
gacatcaatggtgc

SEQ ID NO: 1381 - DNA, 16 bp, Artificial Sequence
  Antisense nucleotide
gtagacatcaatggtg

SEQ ID NO: 1382 - DNA, 18 bp, Artificial Sequence
  Antisense nucleotide
catgatcatgtagacatc

SEQ ID NO: 1383 - DNA, 16 bp, Artificial Sequence
  Antisense nucleotide
ccatgatcatgtagac

SEQ ID NO: 1384 - DNA, 18 bp, Artificial Sequence
  Antisense nucleotide
catttgaccatgatcatg

SEQ ID NO: 1385 - DNA, 16 bp, Artificial Sequence
  Antisense nucleotide
ccaacatttgaccatg

SEQ ID NO: 1386 - DNA, 18 bp, Artificial Sequence
  Antisense nucleotide
tcatccaacatttgacca

SEQ ID NO: 1387 - DNA, 18 bp, Artificial Sequence
  Antisense nucleotide
gagtcaatcatccaacat

SEQ ID NO: 1388 - DNA, 16 bp, Artificial Sequence
  Antisense nucleotide
cagagtcaatcatcca

SEQ ID NO: 1389 - DNA, 14 bp, Artificial Sequence
  Antisense nucleotide
ccgacattcagagt

SEQ ID NO: 1390 - DNA, 16 bp, Artificial Sequence
  Antisense nucleotide
gaattcagacaccaac

SEQ ID NO: 1391 - DNA, 14 bp, Artificial Sequence
  Antisense nucleotide
gatgaccacaaagc

SEQ ID NO: 1392 - DNA, 16 bp, Artificial Sequence
  Antisense nucleotide
ccatcaaatacatcgg

SEQ ID NO: 1393 - DNA, 18 bp, Artificial Sequence
  Antisense nucleotide
tcaccatcaaatacatcg

SEQ ID NO: 1394 - DNA, 14 bp, Artificial Sequence
  Antisense nucleotide
caacgtagccatca

SEQ ID NO: 1395 - DNA, 14 bp, Artificial Sequence
  Antisense nucleotide
acgtctttgacgac

SEQ ID NO: 1396 - DNA, 18 bp, Artificial Sequence
  Antisense nucleotide
caaaaacgtctttgacga

SEQ ID NO: 1397 - DNA, 16 bp, Artificial Sequence
  Antisense nucleotide
ggcaaaaacgtctttg

SEQ ID NO: 1398 - DNA, 16 bp, Artificial Sequence
  Antisense nucleotide
caaaggcaaaaacgtc

SEQ ID NO: 1399 - DNA, 14 bp, Artificial Sequence
  Antisense nucleotide
gtgtcaagtactcg

SEQ ID NO: 1400 - DNA, 16 bp, Artificial Sequence
  Antisense nucleotide
gtaatagaggttgtcg

SEQ ID NO: 1401 - DNA, 14 bp, Artificial Sequence
  Antisense nucleotide
cccagtaatagagg

SEQ ID NO: 1402 - DNA, 14 bp, Artificial Sequence
  Antisense nucleotide
catggtgctcactg

SEQ ID NO: 1403 - DNA, 14 bp, Artificial Sequence
  Antisense nucleotide
gtgcctgtacgtac

SEQ ID NO: 1404 - DNA, 14 bp, Artificial Sequence
  Antisense nucleotide
tgcaggtggatagt

SEQ ID NO: 1405 - DNA, 18 bp, Artificial Sequence
  Antisense nucleotide
catgtcgatagtcttgca

SEQ ID NO: 1406 - DNA, 14 bp, Artificial Sequence
  Antisense nucleotide
gtcgatagtcttgc

SEQ ID NO: 1407 - DNA, 14 bp, Artificial Sequence
  Antisense nucleotide
ccatgtcgatagtc

SEQ ID NO: 1408 - DNA, 14 bp, Artificial Sequence
  Antisense nucleotide
ctccatgtcgatag

SEQ ID NO: 1409 - DNA, 14 bp, Artificial Sequence
  Antisense nucleotide
cttggacaggatct

SEQ ID NO: 1410 - DNA, 14 bp, Artificial Sequence
  Antisense nucleotide
tgctgttgtacagg

SEQ ID NO: 1411 - DNA, 14 bp, Artificial Sequence
  Antisense nucleotide
gtgctgttgtacag

SEQ ID NO: 1412 - DNA, 14 bp, Artificial Sequence
  Antisense nucleotide
ttggcgtagtagtc

SEQ ID NO: 1413 - DNA, 14 bp, Artificial Sequence
  Antisense nucleotide
tccaccattagcac

SEQ ID NO: 1414 - DNA, 14 bp, Artificial Sequence
  Antisense nucleotide
gatttcgttgtggg

SEQ ID NO: 1415 - DNA, 18 bp, Artificial Sequence
  Antisense nucleotide
gtcatagatttcgttgtg

SEQ ID NO: 1416 - DNA, 16 bp, Artificial Sequence
  Antisense nucleotide
tgtactctgcttgaac

SEQ ID NO: 1417 - DNA, 14 bp, Artificial Sequence
  Antisense nucleotide
gtgtactctgcttg

SEQ ID NO: 1418 - DNA, 14 bp, Artificial Sequence
  Antisense nucleotide
tgctgtgtgtactc

SEQ ID NO: 1419 - DNA, 18 bp, Artificial Sequence
  Antisense nucleotide
ctgatgtgttgaagaaca

SEQ ID NO: 1420 - DNA, 16 bp, Artificial Sequence
  Antisense nucleotide
ctctgatgtgttgaag

SEQ ID NO: 1421 - DNA, 14 bp, Artificial Sequence
  Antisense nucleotide
gctctgatgtgttg

SEQ ID NO: 1422 - DNA, 14 bp, Artificial Sequence
  Antisense nucleotide
gagctctgatgtgt

SEQ ID NO: 1423 - DNA, 18 bp, Artificial Sequence
  Antisense nucleotide
cacttttaacttgagcct

SEQ ID NO: 1424 - DNA, 18 bp, Artificial Sequence
  Antisense nucleotide
ctccacttttaacttgag

SEQ ID NO: 1425 - DNA, 18 bp, Artificial Sequence
  Antisense nucleotide
tgctgtatttctggtaca

SEQ ID NO: 1426 - DNA, 14 bp, Artificial Sequence
  Antisense nucleotide
ccaggaattgttgc

SEQ ID NO: 1427 - DNA, 14 bp, Artificial Sequence
  Antisense nucleotide
ttgctgaggtatcg

SEQ ID NO: 1428 - DNA, 14 bp, Artificial Sequence
  Antisense nucleotide
gataaccactctgg

SEQ ID NO: 1429 - DNA, 18 bp, Artificial Sequence
  Antisense nucleotide
caaaagataaccactctg

SEQ ID NO: 1430 - DNA, 15 bp, Artificial Sequence
  Antisense nucleotide
cggtgacatcaaaag

SEQ ID NO: 1431 - DNA, 14 bp, Artificial Sequence
  Antisense nucleotide
cctcaatttcccct

SEQ ID NO: 1432 - DNA, 14 bp, Artificial Sequence
  Antisense nucleotide
gttatccctgctgt

SEQ ID NO: 1433 - DNA, 14 bp, Artificial Sequence
  Antisense nucleotide
gcagtgtgttatcc

SEQ ID NO: 1434 - DNA, 14 bp, Artificial Sequence
  Antisense nucleotide
gatgtccacttgca

SEQ ID NO: 1435 - DNA, 14 bp, Artificial Sequence
  Antisense nucleotide
tagtgaacccgttg

SEQ ID NO: 1436 - DNA, 14 bp, Artificial Sequence
  Antisense nucleotide
tgccatgaatggtg

SEQ ID NO: 1437 - DNA, 16 bp, Artificial Sequence
  Antisense nucleotide
gttcatgccatgaatg

SEQ ID NO: 1438 - DNA, 14 bp, Artificial Sequence
  Antisense nucleotide
catgagaagcagga

SEQ ID NO: 1439 - DNA, 14 bp, Artificial Sequence
  Antisense nucleotide
gctttgcagatgct

SEQ ID NO: 1440 - DNA, 14 bp, Artificial Sequence
  Antisense nucleotide
gagctttgcagatg

SEQ ID NO: 1441 - DNA, 14 bp, Artificial Sequence
  Antisense nucleotide
tagttggtgtccag

SEQ ID NO: 1442 - DNA, 16 bp, Artificial Sequence
  Antisense nucleotide
ctgaagcaatagttgg

SEQ ID NO: 1443 - DNA, 18 bp, Artificial Sequence
  Antisense nucleotide
agctgaagcaatagttgg

SEQ ID NO: 1444 - DNA, 14 bp, Artificial Sequence
  Antisense nucleotide
ggagctgaagcaat

SEQ ID NO: 1445 - DNA, 14 bp, Artificial Sequence
  Antisense nucleotide
caatgtacagctgc

SEQ ID NO: 1446 - DNA, 16 bp, Artificial Sequence
  Antisense nucleotide
ggaagtcaatgtacag

SEQ ID NO: 1447 - DNA, 15 bp, Artificial Sequence
  Antisense nucleotide
cggaagtcaatgtac

SEQ ID NO: 1448 - DNA, 14 bp, Artificial Sequence
  Antisense nucleotide
gcggaagtcaatgt

SEQ ID NO: 1449 - DNA, 14 bp, Artificial Sequence
  Antisense nucleotide
agttggcatggtag

SEQ ID NO: 1450 - DNA, 14 bp, Artificial Sequence
  Antisense nucleotide
gcagaagttggcat

SEQ ID NO: 1451 - DNA, 14 bp, Artificial Sequence
  Antisense nucleotide
ctccaaatgtaggg

SEQ ID NO: 1452 - DNA, 14 bp, Artificial Sequence
  Antisense nucleotide
accttgctgtactg

SEQ ID NO: 1453 - DNA, 14 bp, Artificial Sequence
  Antisense nucleotide
tgctggttgtacag

SEQ ID NO: 1454 - DNA, 14 bp, Artificial Sequence
  Antisense nucleotide
ggttatgctggttg

SEQ ID NO: 1455 - DNA, 14 bp, Artificial Sequence
  Antisense nucleotide
gtagtacacgatgg

SEQ ID NO: 1456 - DNA, 14 bp, Artificial Sequence
  Antisense nucleotide
cgtagtacacgatg

SEQ ID NO: 1457 - DNA, 14 bp, Artificial Sequence
  Antisense nucleotide
cacgtagtacacga

SEQ ID NO: 1458 - DNA, 14 bp, Artificial Sequence
  Antisense nucleotide
catgttggacagct

SEQ ID NO: 1459 - DNA, 14 bp, Artificial Sequence
  Antisense nucleotide
gcacgatcatgttg

SEQ ID NO: 1460 - DNA, 14 bp, Artificial Sequence
  Antisense nucleotide
cacacagtagtgca

SEQ ID NO: 1461 - DNA, 14 bp, Artificial Sequence
  Antisense nucleotide
gatcagaaaagcgc

SEQ ID NO: 1462 - DNA, 14 bp, Artificial Sequence
  Antisense nucleotide
accgtgaccagatg

SEQ ID NO: 1463 - DNA, 14 bp, Artificial Sequence
  Antisense nucleotide
gtagacaggctgag

SEQ ID NO: 1464 - DNA, 14 bp, Artificial Sequence
  Antisense nucleotide
tatcgagtgtgctg

SEQ ID NO: 1465 - DNA, 14 bp, Artificial Sequence
  Antisense nucleotide
ttgcgcatgaactg

SEQ ID NO: 1466 - DNA, 14 bp, Artificial Sequence
  Antisense nucleotide
ttgctcaggatctg

SEQ ID NO: 1467 - DNA, 14 bp, Artificial Sequence
  Antisense nucleotide
actggtgagcttca

SEQ ID NO: 1468 - DNA, 14 bp, Artificial Sequence
  Antisense nucleotide
gctcaggatagtct

SEQ ID NO: 1469 - DNA, 18 bp, Artificial Sequence
  Antisense nucleotide
tgtagatggaaatcacct

SEQ ID NO: 1470 - DNA, 14 bp, Artificial Sequence
  Antisense nucleotide
tggtgctgttgtag

SEQ ID NO: 1471 - DNA, 14 bp, Artificial Sequence
  Antisense nucleotide
ttctcctggagcaa

SEQ ID NO: 1472 - DNA, 14 bp, Artificial Sequence
  Antisense nucleotide
tactcttcgtcgct

SEQ ID NO: 1473 - DNA, 14 bp, Artificial Sequence
  Antisense nucleotide
cttggcgtagtact

SEQ ID NO: 1474 - DNA, 18 bp, Artificial Sequence
  Antisense nucleotide
cggcatgtctattttgta

SEQ ID NO: 1475 - DNA, 14 bp, Artificial Sequence
  Antisense nucleotide
cgggatggcatttt

SEQ ID NO: 1476 - DNA, 14 bp, Artificial Sequence
  Antisense nucleotide
ctgtagaaagtggg

SEQ ID NO: 1477 - DNA, 18 bp, Artificial Sequence
  Antisense nucleotide
acaattctgaagtagggt

SEQ ID NO: 1478 - DNA, 18 bp, Artificial Sequence
  Antisense nucleotide
attgctgagacgtcaaat

SEQ ID NO: 1479 - DNA, 14 bp, Artificial Sequence
  Antisense nucleotide
tctccattgctgag

SEQ ID NO: 1480 - DNA, 18 bp, Artificial Sequence
  Antisense nucleotide
tcaccaaattggaagcat

SEQ ID NO: 1481 - DNA, 14 bp, Artificial Sequence
  Antisense nucleotide
ctctgaactctgct

SEQ ID NO: 1482 - DNA, 18 bp, Artificial Sequence
  Antisense nucleotide
aacgaaagactctgaact

SEQ ID NO: 1483 - DNA, 14 bp, Artificial Sequence
  Antisense nucleotide
tgggttctgcaaac

SEQ ID NO: 1484 - DNA, 14 bp, Artificial Sequence
  Antisense nucleotide
ctggcttttgggtt

SEQ ID NO: 1485 - DNA, 14 bp, Artificial Sequence
  Antisense nucleotide
gttgttcaggcact

SEQ ID NO: 1486 - DNA, 18 bp, Artificial Sequence
  Antisense nucleotide
tctgatatagctcaatcc

SEQ ID NO: 1487 - DNA, 18 bp, Artificial Sequence
  Antisense nucleotide
tctttggacttgagaatc

SEQ ID NO: 1488 - DNA, 14 bp, Artificial Sequence
  Antisense nucleotide
tgggttggagatgt

SEQ ID NO: 1489 - DNA, 14 bp, Artificial Sequence
  Antisense nucleotide
tgctgtcgatgtag

SEQ ID NO: 1490 - DNA, 16 bp, Artificial Sequence
  Antisense nucleotide
acaactttgctgtcga

SEQ ID NO: 1491 - DNA, 14 bp, Artificial Sequence
  Antisense nucleotide
attcgccttctgct

SEQ ID NO: 1492 - DNA, 14 bp, Artificial Sequence
  Antisense nucleotide
gaaggagagccatt

SEQ ID NO: 1493 - DNA, 16 bp, Artificial Sequence
  Antisense nucleotide
tcagttacatcgaagg

SEQ ID NO: 1494 - DNA, 18 bp, Artificial Sequence
  Antisense nucleotide
tgaagccattcatgaaca

SEQ ID NO: 1495 - DNA, 16 bp, Artificial Sequence
  Antisense nucleotide
tcctgtctttatggtg

SEQ ID NO: 1496 - DNA, 14 bp, Artificial Sequence
  Antisense nucleotide
aaatcccaggttcc

SEQ ID NO: 1497 - DNA, 18 bp, Artificial Sequence
  Antisense nucleotide
ggacagtgtaagcttatt

SEQ ID NO: 1498 - DNA, 16 bp, Artificial Sequence
  Antisense nucleotide
gtacaaaagtgcagca

SEQ ID NO: 1499 - DNA, 18 bp, Artificial Sequence
  Antisense nucleotide
tagatggtacaaaagtgc

SEQ ID NO: 1500 - DNA, 20 bp, Artificial Sequence
  Antisense nucleotide
cacttttatttgggatgatg

SEQ ID NO: 1501 - DNA, 18 bp, Artificial Sequence
  Antisense nucleotide
gcaaatcttgcttctagt

SEQ ID NO: 1502 - DNA, 14 bp, Artificial Sequence
  Antisense nucleotide
gtgccatcaatacc

SEQ ID NO: 1503 - DNA, 14 bp, Artificial Sequence
  Antisense nucleotide
ggtatatgtggagg

SEQ ID NO: 1504 - DNA, 14 bp, Artificial Sequence
  Antisense nucleotide
tctgatcaccactg

SEQ ID NO: 1505 - DNA, 18 bp, Artificial Sequence
  Antisense nucleotide
tcctagtggactttatag

SEQ ID NO: 1506 - DNA, 16 bp, Artificial Sequence
  Antisense nucleotide
tttttcctagtggact

SEQ ID NO: 1507 - DNA, 16 bp, Artificial Sequence
  Antisense nucleotide
caataacattagcagg

SEQ ID NO: 1508 - DNA, 14 bp, Artificial Sequence
  Antisense nucleotide
aagtctgtaggagg

SEQ ID NO: 1509 - DNA, 16 bp, Artificial Sequence
  Antisense nucleotide
tctgttgtgactcaag

SEQ ID NO: 1510 - DNA, 14 bp, Artificial Sequence
  Antisense nucleotide
gttggtctgttgtg

SEQ ID NO: 1511 - DNA, 14 bp, Artificial Sequence
  Antisense nucleotide
caaagcacgcttct

SEQ ID NO: 1512 - DNA, 18 bp, Artificial Sequence
  Antisense nucleotide
tttctaaagcaataggcc

SEQ ID NO: 1513 - DNA, 16 bp, Artificial Sequence
  Antisense nucleotide
gcaattatcctgcaca

SEQ ID NO: 1514 - DNA, 14 bp, Artificial Sequence
  Antisense nucleotide
acgtaggcagcaat

SEQ ID NO: 1515 - DNA, 18 bp, Artificial Sequence
  Antisense nucleotide
atcaatgtaaagtggacg

SEQ ID NO: 1516 - DNA, 14 bp, Artificial Sequence
  Antisense nucleotide
ctagatccctcttg

SEQ ID NO: 1517 - DNA, 14 bp, Artificial Sequence
  Antisense nucleotide
ccatttccacccta

SEQ ID NO: 1518 - DNA, 14 bp, Artificial Sequence
  Antisense nucleotide
tgggttcgtgtatc

SEQ ID NO: 1519 - DNA, 14 bp, Artificial Sequence
  Antisense nucleotide
tggcattgtaccct

SEQ ID NO: 1520 - DNA, 14 bp, Artificial Sequence
  Antisense nucleotide
tccagcacagaagt

SEQ ID NO: 1521 - DNA, 16 bp, Artificial Sequence
  Antisense nucleotide
ataaatacgggcatgc

SEQ ID NO: 1522 - DNA, 14 bp, Artificial Sequence
  Antisense nucleotide
agtgtctgaactcc

SEQ ID NO: 1523 - DNA, 14 bp, Artificial Sequence
  Antisense nucleotide
tgtgctgagtgtct

SEQ ID NO: 1524 - DNA, 14 bp, Artificial Sequence
  Antisense nucleotide
ataagctcaggacc

SEQ ID NO: 1525 - DNA, 14 bp, Artificial Sequence
  Antisense nucleotide
aggagaagcagatg

SEQ ID NO: 1526 - DNA, 14 bp, Artificial Sequence
  Antisense nucleotide
agcaaggagaagca

SEQ ID NO: 1527 - DNA, 14 bp, Artificial Sequence
  Antisense nucleotide
aatcttgggacacg

SEQ ID NO: 1528 - DNA, 18 bp, Artificial Sequence
  Antisense nucleotide
tagagaatggttagaggt

SEQ ID NO: 1529 - DNA, 18 bp, Artificial Sequence
  Antisense nucleotide
gttttgccaatgtagtag

SEQ ID NO: 1530 - DNA, 14 bp, Artificial Sequence
  Antisense nucleotide
cttgggtgttttgc

SEQ ID NO: 1531 - DNA, 16 bp, Artificial Sequence
  Antisense nucleotide
gcaagactttacaatc

SEQ ID NO: 1532 - DNA, 18 bp, Artificial Sequence
  Antisense nucleotide
gcatttgcaagactttac

SEQ ID NO: 1533 - DNA, 18 bp, Artificial Sequence
  Antisense nucleotide
tttagctgcatttgcaag

SEQ ID NO: 1534 - DNA, 14 bp, Artificial Sequence
  Antisense nucleotide
gccacttttccaag

SEQ ID NO: 1535 - DNA, 14 bp, Artificial Sequence
  Antisense nucleotide
ttggtcttgccact

SEQ ID NO: 1536 - DNA, 14 bp, Artificial Sequence
  Antisense nucleotide
cagcacacagtagt

SEQ ID NO: 1537 - DNA, 14 bp, Artificial Sequence
  Antisense nucleotide
cgatagtcttgcag

SEQ ID NO: 1538 - DNA, 18 bp, Artificial Sequence
  Antisense nucleotide
ctttcaccaaattggaag

SEQ ID NO: 1539 - DNA, 15 bp, Artificial Sequence
  Antisense nucleotide
caccaaattggaagc

SEQ ID NO: 1540 - DNA, 16 bp, Artificial Sequence
  Antisense nucleotide
tcaccaaattggaagc

SEQ ID NO: 1541 - DNA, 14 bp, Artificial Sequence
  Antisense nucleotide
ctctggcttttggg

SEQ ID NO: 1542 - DNA, 16 bp, Artificial Sequence
  Antisense nucleotide
cggcatgtctattttg

SEQ ID NO: 1543 - DNA, 14 bp, Artificial Sequence
  Antisense nucleotide
cactacagacgagc

SEQ ID NO: 1544 - DNA, 15 bp, Artificial Sequence
  Antisense nucleotide
cgtgcactacagacg

SEQ ID NO: 1545 - DNA, 14 bp, Artificial Sequence
  Antisense nucleotide
ggaacagttcgtcc

SEQ ID NO: 1546 - DNA, 16 bp, Artificial Sequence
  Antisense nucleotide
gaacagttcgtccatg

SEQ ID NO: 1547 - DNA, 15 bp, Artificial Sequence
  Antisense nucleotide
ccagagtttcggttc

SEQ ID NO: 1548 - DNA, 15 bp, Artificial Sequence
  Antisense nucleotide
ctaggactgggacag

SEQ ID NO: 1549 - DNA, 13 bp, Artificial Sequence
  Antisense nucleotide
cgcacttgtagcg

SEQ ID NO: 1550 - DNA, 14 bp, Artificial Sequence
  Antisense nucleotide
ctcgcacttgtagc

SEQ ID NO: 1551 - DNA, 11 bp, Artificial Sequence
  Antisense nucleotide
gcacttgtagc

SEQ ID NO: 1552 - DNA, 14 bp, Artificial Sequence
  Antisense nucleotide
gcgcactgtccctg

SEQ ID NO: 1553 - DNA, 14 bp, Artificial Sequence
  Antisense nucleotide
ccagggagatgcgc

SEQ ID NO: 1554 - DNA, 13 bp, Artificial Sequence
  Antisense nucleotide
gccggtgaggagg

SEQ ID NO: 1555 - DNA, 13 bp, Artificial Sequence
  Antisense nucleotide
ccggtgaggaggg

SEQ ID NO: 1556 - DNA, 13 bp, Artificial Sequence
  Antisense nucleotide
cggttcactcggc

SEQ ID NO: 1557 - DNA, 16 bp, Artificial Sequence
  Antisense nucleotide
gagtttcggttcactc

SEQ ID NO: 1558 - DNA, 16 bp, Artificial Sequence
  Antisense nucleotide
ggcacgattgtcaaag

SEQ ID NO: 1559 - DNA, 14 bp, Artificial Sequence
  Antisense nucleotide
caggcgtcaccccc

SEQ ID NO: 1560 - DNA, 13 bp, Artificial Sequence
  Antisense nucleotide
gcaggcgtcaccc

SEQ ID NO: 1561 - DNA, 13 bp, Artificial Sequence
  Antisense nucleotide
ctccctcctaagc

SEQ ID NO: 1562 - DNA, 13 bp, Artificial Sequence
  Antisense nucleotide
ccctcctaagcgg

SEQ ID NO: 1563 - DNA, 14 bp, Artificial Sequence
  Antisense nucleotide
cgagtccgcgttcg

SEQ ID NO: 1564 - DNA, 15 bp, Artificial Sequence
  Antisense nucleotide
catcttctgccattc

SEQ ID NO: 1565 - DNA, 15 bp, Artificial Sequence
  Antisense nucleotide
gtgttttcccaccag

SEQ ID NO: 1566 - DNA, 16 bp, Artificial Sequence
  Antisense nucleotide
ggttttggttcactag

SEQ ID NO: 1567 - DNA, 16 bp, Artificial Sequence
  Antisense nucleotide
gcatcttcacgtctcc

SEQ ID NO: 1568 - DNA, 16 bp, Artificial Sequence
  Antisense nucleotide
cttcacgtctcctgtc

SEQ ID NO: 1569 - DNA, 14 bp, Artificial Sequence
  Antisense nucleotide
gtcaccgcgtagtc

SEQ ID NO: 1570 - DNA, 15 bp, Artificial Sequence
  Antisense nucleotide
caaataggcaaggtc

SEQ ID NO: 1571 - DNA, 16 bp, Artificial Sequence
  Antisense nucleotide
cttgcaaataggcaag

SEQ ID NO: 1572 - DNA, 14 bp, Artificial Sequence
  Antisense nucleotide
tgcttgcaaatagg

SEQ ID NO: 1573 - DNA, 15 bp, Artificial Sequence
  Antisense nucleotide
ctgcttgcaaatagg

SEQ ID NO: 1574 - DNA, 14 bp, Artificial Sequence
  Antisense nucleotide
gcaggtggatattt

SEQ ID NO: 1575 - DNA, 13 bp, Artificial Sequence
  Antisense nucleotide
ctgctgttggcag

SEQ ID NO: 1576 - DNA, 15 bp, Artificial Sequence
  Antisense nucleotide
cactagtttccaagt

SEQ ID NO: 1577 - DNA, 15 bp, Artificial Sequence
  Antisense nucleotide
gttttggttcactag

SEQ ID NO: 1578 - DNA, 17 bp, Artificial Sequence
  Antisense nucleotide
ctttgatttcaggatag

SEQ ID NO: 1579 - DNA, 17 bp, Artificial Sequence
  Antisense nucleotide
gcacttcttctttatct

SEQ ID NO: 1580 - DNA, 15 bp, Artificial Sequence
  Antisense nucleotide
ccaagtcagatttcc

SEQ ID NO: 1581 - DNA, 18 bp, Artificial Sequence
  Antisense nucleotide
gtttccaagtcagatttc

SEQ ID NO: 1582 - DNA, 15 bp, Artificial Sequence
  Antisense nucleotide
ggttcactagtttcc

SEQ ID NO: 1583 - DNA, 16 bp, Artificial Sequence
  Antisense nucleotide
ggttttggttcactag

SEQ ID NO: 1584 - DNA, 15 bp, Artificial Sequence
  Antisense nucleotide
ccgaaaaattgggca

SEQ ID NO: 1585 - DNA, 13 bp, Artificial Sequence
  Antisense nucleotide
ccgaaaaattggg

SEQ ID NO: 1586 - DNA, 16 bp, Artificial Sequence
  Antisense nucleotide
ctatccgaaaaattgg

SEQ ID NO: 1587 - DNA, 17 bp, Artificial Sequence
  Antisense nucleotide
gttgataatgtcatcag

SEQ ID NO: 1588 - DNA, 17 bp, Artificial Sequence
  Antisense nucleotide
ctcatgttgataatgtc

SEQ ID NO: 1589 - DNA, 14 bp, Artificial Sequence
  Antisense nucleotide
ctgtcaccgcgtag

SEQ ID NO: 1590 - DNA, 15 bp, Artificial Sequence
  Antisense nucleotide
cgtctcctgtcaccg

SEQ ID NO: 1591 - DNA, 14 bp, Artificial Sequence
  Antisense nucleotide
cttcacgtctcctg

SEQ ID NO: 1592 - DNA, 17 bp, Artificial Sequence
  Antisense nucleotide
gagaactttatcatgtc

SEQ ID NO: 1593 - DNA, 13 bp, Artificial Sequence
  Antisense nucleotide
gctatatgcaggg

SEQ ID NO: 1594 - DNA, 18 bp, Artificial Sequence
  Antisense nucleotide
ccagctgctatatgcagg

SEQ ID NO: 1595 - DNA, 16 bp, Artificial Sequence
  Antisense nucleotide
aggctaaattttgcct

SEQ ID NO: 1596 - DNA, 14 bp, Artificial Sequence
  Antisense nucleotide
ggctaaattttgcc

SEQ ID NO: 1597 - DNA, 17 bp, Artificial Sequence
  Antisense nucleotide
ggctaaattttgccttc

SEQ ID NO: 1598 - DNA, 17 bp, Artificial Sequence
  Antisense nucleotide
gcaggctaaattttgcc

SEQ ID NO: 1599 - DNA, 14 bp, Artificial Sequence
  Antisense nucleotide
gagttacccaagcg

SEQ ID NO: 1600 - DNA, 16 bp, Artificial Sequence
  Antisense nucleotide
cagagttacccaagcg

SEQ ID NO: 1601 - DNA, 14 bp, Artificial Sequence
  Antisense nucleotide
cagagttacccaag

SEQ ID NO: 1602 - DNA, 15 bp, Artificial Sequence
  Antisense nucleotide
acagagttacccaag

SEQ ID NO: 1603 - DNA, 14 bp, Artificial Sequence
  Antisense nucleotide
ggtgcaaaacagag

SEQ ID NO: 1604 - DNA, 15 bp, Artificial Sequence
  Antisense nucleotide
ctaggtgcaaaacag

SEQ ID NO: 1605 - DNA, 18 bp, Artificial Sequence
  Antisense nucleotide
gagaactttatcatgtcc

SEQ ID NO: 1606 - DNA, 14 bp, Artificial Sequence
  Antisense nucleotide
gctagatgaatggc

SEQ ID NO: 1607 - DNA, 15 bp, Artificial
  Antisense nucleotide
gcaaacatggcaggc

SEQ ID NO: 1608 - DNA, 14 bp, Artificial Sequence
  Antisense nucleotide
cagcaaacatggca

SEQ ID NO: 1609 - DNA, 14 bp, Artificial Sequence
  Antisense nucleotide
gcagcaaacatggc

SEQ ID NO: 1610 - DNA, 14 bp, Artificial Sequence
  Antisense nucleotide
agcagcaaacatgg

SEQ ID NO: 1611 - DNA, 14 bp, Artificial Sequence
  Antisense nucleotide
cagcagcaaacatg

SEQ ID NO: 1612 - DNA, 14 bp, Artificial Sequence
  Antisense nucleotide
agcagcagcaaaca

SEQ ID NO: 1613 - DNA, 15 bp, Artificial Sequence
  Antisense nucleotide
cagcagcagcaaaca

SEQ ID NO: 1614 - DNA, 14 bp, Artificial Sequence
  Antisense nucleotide
cagcagcagcaaac

SEQ ID NO: 1615 - DNA, 14 bp, Artificial Sequence
  Antisense nucleotide
caccagcagcagca

SEQ ID NO: 1616 - DNA, 14 bp, Artificial Sequence
  Antisense nucleotide
gcattgacgtcagc

SEQ ID NO: 1617 - DNA, 15 bp, Artificial Sequence
  Antisense nucleotide
gatgttgtcgtgctc

SEQ ID NO: 1618 - DNA, 17 bp, Artificial Sequence
  Antisense nucleotide
tgagatgttgtcgtgct

SEQ ID NO: 1619 - DNA, 15 bp, Artificial Sequence
  Antisense nucleotide
tgagatgttgtcgtg

SEQ ID NO: 1620 - DNA, 15 bp, Artificial Sequence
  Antisense nucleotide
gccaatgagatgttg

SEQ ID NO: 1621 - DNA, 14 bp, Artificial Sequence
  Antisense nucleotide
ctgccaatgagatg

SEQ ID NO: 1622 - DNA, 14 bp, Artificial Sequence
  Antisense nucleotide
cacatgggcatcac

SEQ ID NO: 1623 - DNA, 14 bp, Artificial Sequence
  Antisense nucleotide
tgtccacatgggca

SEQ ID NO: 1624 - DNA, 14 bp, Artificial Sequence
  Antisense nucleotide
gtactgtccacatg

SEQ ID NO: 1625 - DNA, 14 bp, Artificial Sequence
  Antisense nucleotide
cagctgctatatgc

SEQ ID NO: 1626 - DNA, 14 bp, Artificial Sequence
  Antisense nucleotide
gttctccaccaggg

SEQ ID NO: 1627 - DNA, 14 bp, Artificial Sequence
  Antisense nucleotide
agttctccaccagg

SEQ ID NO: 1628 - DNA, 16 bp, Artificial Sequence
  Antisense nucleotide
caaagttctccaccag

SEQ ID NO: 1629 - DNA, 16 bp, Artificial Sequence
  Antisense nucleotide
ccaagagtcatccagg

SEQ ID NO: 1630 - DNA, 14 bp, Artificial Sequence
  Antisense nucleotide
cccaagagtcatcc

SEQ ID NO: 1631 - DNA, 16 bp, Artificial Sequence
  Antisense nucleotide
cctgcattttcccaag

SEQ ID NO: 1632 - DNA, 14 bp, Artificial Sequence
  Antisense nucleotide
tcctgcattttccc

SEQ ID NO: 1633 - DNA, 15 bp, Artificial Sequence
  Antisense nucleotide
gccatatctagaggc

SEQ ID NO: 1634 - DNA, 14 bp, Artificial Sequence
  Antisense nucleotide
tcacatcttcagcc

SEQ ID NO: 1635 - DNA, 16 bp, Artificial Sequence
  Antisense nucleotide
gcttcacatcttcagc

SEQ ID NO: 1636 - DNA, 15 bp, Artificial Sequence
  Antisense nucleotide
cagcttcacatcttc

SEQ ID NO: 1637 - DNA, 17 bp, Artificial Sequence
  Antisense nucleotide
gtaacttatacagctgc

SEQ ID NO: 1638 - DNA, 15 bp, Artificial Sequence
  Antisense nucleotide
ccagtttttgtctgg

SEQ ID NO: 1639 - DNA, 14 bp, Artificial Sequence
  Antisense nucleotide
ccatttgtctcagg

SEQ ID NO: 1640 - DNA, 14 bp, Artificial Sequence
  Antisense nucleotide
gtgtagcccatttg

SEQ ID NO: 1641 - DNA, 14 bp, Artificial Sequence
  Antisense nucleotide
gcttcggtgtagcc

SEQ ID NO: 1642 - DNA, 18 bp, Artificial Sequence
  Antisense nucleotide
gatcacttcaattgcttc

SEQ ID NO: 1643 - DNA, 14 bp, Artificial Sequence
  Antisense nucleotide
cttgtggaggcagg

SEQ ID NO: 1644 - DNA, 14 bp, Artificial Sequence
  Antisense nucleotide
gctgccttgtggag

SEQ ID NO: 1645 - DNA, 18 bp, Artificial Sequence
  Antisense nucleotide
ctatttgctgccttgtgg

SEQ ID NO: 1646 - DNA, 14 bp, Artificial Sequence
  Antisense nucleotide
ggatgtctccacgc

SEQ ID NO: 1647 - DNA, 14 bp, Artificial Sequence
  Antisense nucleotide
ggaaggatgtctcc

SEQ ID NO: 1648 - DNA, 14 bp, Artificial Sequence
  Antisense nucleotide
tgcggaaggatgtc

SEQ ID NO: 1649 - DNA, 17 bp, Artificial Sequence
  Antisense nucleotide
gtttgcggaaggatgtc

SEQ ID NO: 1650 - DNA, 14 bp, Artificial Sequence
  Antisense nucleotide
gctgagtttgcgga

SEQ ID NO: 1651 - DNA, 16 bp, Artificial Sequence
  Antisense nucleotide
ggtaaagctgagtttg

SEQ ID NO: 1652 - DNA, 14 bp, Artificial Sequence
  Antisense nucleotide
tcggtaaagctgag

SEQ ID NO: 1653 - DNA, 15 bp, Artificial Sequence
  Antisense nucleotide
gactcggtaaagctg

SEQ ID NO: 1654 - DNA, 16 bp, Artificial Sequence
  Antisense nucleotide
agagactcggtaaagc

SEQ ID NO: 1655 - DNA, 16 bp, Artificial Sequence
  Antisense nucleotide
gaaattgtcagcaggc

SEQ ID NO: 1656 - DNA, 15 bp, Artificial Sequence
  Antisense nucleotide
gaaattgtcagcagg

SEQ ID NO: 1657 - DNA, 16 bp, Artificial Sequence
  Antisense nucleotide
ggaaattgtcagcagg

SEQ ID NO: 1658 - DNA, 15 bp, Artificial Sequence
  Antisense nucleotide
ggaaattgtcagcag

SEQ ID NO: 1659 - DNA, 14 bp, Artificial Sequence
  Antisense nucleotide
gggaaattgtcagc

SEQ ID NO: 1660 - DNA, 15 bp, Artificial Sequence
  Antisense nucleotide
gtgtgggaaattgtc

SEQ ID NO: 1661 - DNA, 15 bp, Artificial Sequence
  Antisense nucleotide
ggtttacacggtgtg

SEQ ID NO: 1662 - DNA, 15 bp, Artificial Sequence
  Antisense nucleotide
gctttggtttacacg

SEQ ID NO: 1663 - DNA, 15 bp, Artificial Sequence
  Antisense nucleotide
gcacctttgggatgc

SEQ ID NO: 1664 - DNA, 15 bp, Artificial Sequence
  Antisense nucleotide
ccaggttctgcttcc

SEQ ID NO: 1665 - DNA, 15 bp, Artificial Sequence
  Antisense nucleotide
gctctgtctagtggc

SEQ ID NO: 1666 - DNA, 14 bp, Artificial Sequence
  Antisense nucleotide
actctccatgtctc

SEQ ID NO: 1667 - DNA, 16 bp, Artificial Sequence
  Antisense nucleotide
caactctccatgtctc

SEQ ID NO: 1668 - DNA, 14 bp, Artificial Sequence
  Antisense nucleotide
caactctccatgtc

SEQ ID NO: 1669 - DNA, 14 bp, Artificial Sequence
  Antisense nucleotide
agcaactctccatg

SEQ ID NO: 1670 - DNA, 16 bp, Artificial Sequence
  Antisense nucleotide
gtagcaactctccatg

SEQ ID NO: 1671 - DNA, 14 bp, Artificial Sequence
  Antisense nucleotide
gtagcaactctcca

SEQ ID NO: 1672 - DNA, 17 bp, Artificial Sequence
  Antisense nucleotide
ggttgtagcaactctcc

SEQ ID NO: 1673 - DNA, 14 bp, Artificial Sequence
  Antisense nucleotide
cgggcagtcctcca

SEQ ID NO: 1674 - DNA, 13 bp, Artificial Sequence
  Antisense nucleotide
gcaccgggcagtc

SEQ ID NO: 1675 - DNA, 13 bp, Artificial Sequence
  Antisense nucleotide
aggcaccgggcag

SEQ ID NO: 1676 - DNA, 15 bp, Artificial Sequence
  Antisense nucleotide
gtgtgttaccaggtc

SEQ ID NO: 1677 - DNA, 15 bp, Artificial Sequence
  Antisense nucleotide
tgtgtgttaccaggt

SEQ ID NO: 1678 - DNA, 14 bp, Artificial Sequence
  Antisense nucleotide
tgggtcactgtgtg

SEQ ID NO: 1679 - DNA, 15 bp, Artificial Sequence
  Antisense nucleotide
cagactgtgggcatg

SEQ ID NO: 1680 - DNA, 16 bp, Artificial Sequence
  Antisense nucleotide
cccaccagactgtggg

SEQ ID NO: 1681 - DNA, 14 bp, Artificial Sequence
  Antisense nucleotide
ccaccagactgtgg

SEQ ID NO: 1682 - DNA, 14 bp, Artificial Sequence
  Antisense nucleotide
tgcccaccagactg

SEQ ID NO: 1683 - DNA, 13 bp, Artificial Sequence
  Antisense nucleotide
cggcttcctcccc

SEQ ID NO: 1684 - DNA, 14 bp, Artificial Sequence
  Antisense nucleotide
ccttgtcttccacc

SEQ ID NO: 1685 - DNA, 14 bp, Artificial Sequence
  Antisense nucleotide
accgaggctgccac

SEQ ID NO: 1686 - DNA, 14 bp, Artificial Sequence
  Antisense nucleotide
ggaagaaaccgagg

SEQ ID NO: 1687 - DNA, 14 bp, Artificial Sequence
  Antisense nucleotide
gggaagaaaccgag

SEQ ID NO: 1688 - DNA, 13 bp, Artificial Sequence
  Antisense nucleotide
ggccatctgcgcc

SEQ ID NO: 1689 - DNA, 13 bp, Artificial Sequence
  Antisense nucleotide
gcggccatctgcg

SEQ ID NO: 1690 - DNA, 14 bp, Artificial Sequence
  Antisense nucleotide
gtggcggccatctg

SEQ ID NO: 1691 - DNA, 14 bp, Artificial Sequence
  Antisense nucleotide
accgtggcggccat

SEQ ID NO: 1692 - DNA, 17 bp, Artificial Sequence
  Antisense nucleotide
gccgctcaatcttcatc

SEQ ID NO: 1693 - DNA, 17 bp, Artificial Sequence
  Antisense nucleotide
cttcatcttgtgatagg

SEQ ID NO: 1694 - DNA, 17 bp, Artificial Sequence
  Antisense nucleotide
gctcaatcttcatcttg

SEQ ID NO: 1695 - DNA, 17 bp, Artificial Sequence
  Antisense nucleotide
cagaaacactgttacag

SEQ ID NO: 1696 - DNA, 17 bp, Artificial Sequence
  Antisense nucleotide
cagttgcagaaacactg

SEQ ID NO: 1697 - DNA, 17 bp, Artificial Sequence
  Antisense nucleotide
gtttcagttgcagaaac

SEQ ID NO: 1698 - DNA, 14 bp, Artificial Sequence
  Antisense nucleotide
cttccaccagaggg

SEQ ID NO: 1699 - DNA, 14 bp, Artificial Sequence
  Antisense nucleotide
gtcttccaccagag

SEQ ID NO: 1700 - DNA, 17 bp, Artificial Sequence
  Antisense nucleotide
cttgtcttccaccagag

SEQ ID NO: 1701 - DNA, 14 bp, Artificial Sequence
  Antisense nucleotide
tccttgtcttccac

SEQ ID NO: 1702 - DNA, 16 bp, Artificial Sequence
  Antisense nucleotide
cttccttgtcttccac

SEQ ID NO: 1703 - DNA, 15 bp, Artificial Sequence
  Antisense nucleotide
catcttgtgataggg

SEQ ID NO: 1704 - DNA, 15 bp, Artificial Sequence
  Antisense nucleotide
gctaggtgcagtggt

SEQ ID NO: 1705 - DNA, 14 bp, Artificial Sequence
  Antisense nucleotide
gatggctaggtgca

SEQ ID NO: 1706 - DNA, 15 bp, Artificial Sequence
  Antisense nucleotide
gtggatgatggctag

SEQ ID NO: 1707 - DNA, 14 bp, Artificial Sequence
  Antisense nucleotide
cccgtggatgatgg

SEQ ID NO: 1708 - DNA, 14 bp, Artificial Sequence
  Antisense nucleotide
ctgcccgtggatga

SEQ ID NO: 1709 - DNA, 14 bp, Artificial Sequence
  Antisense nucleotide
agagcctccaccca

SEQ ID NO: 1710 - DNA, 15 bp, Artificial Sequence
  Antisense nucleotide
gttgtactctcgagc

SEQ ID NO: 1711 - DNA, 13 bp, Artificial Sequence
  Antisense nucleotide
cgttgtactctcg

SEQ ID NO: 1712 - DNA, 14 bp, Artificial Sequence
  Antisense nucleotide
cgcgttgtactctc

SEQ ID NO: 1713 - DNA, 14 bp, Artificial
  Antisense nucleotide
gagtctccatgccg

SEQ ID NO: 1714 - DNA, 14 bp, Artificial
  Antisense nucleotide
ctgagtctccatgc

SEQ ID NO: 1715 - DNA, 14 bp, Artificial
  Antisense nucleotide
catggctgagtctc

SEQ ID NO: 1716 - DNA, 14 bp, Artificial
  Antisense nucleotide
tgcatggctgagtc

SEQ ID NO: 1717 - DNA, 14 bp, Artificial Sequence
  Antisense nucleotide
gcgttcacgttggc

SEQ ID NO: 1718 - DNA, 14 bp, Artificial Sequence
  Antisense nucleotide
gtgcgagcgttcac

SEQ ID NO: 1719 - DNA, 14 bp, Artificial Sequence
  Antisense nucleotide
aggtgcgagcgttc

SEQ ID NO: 1720 - DNA, 14 bp, Artificial Sequence
  Antisense nucleotide
gcaaaggtgcgagc

SEQ ID NO: 1721 - DNA, 14 bp, Artificial Sequence
  Antisense nucleotide
cctggtggctcagg

SEQ ID NO: 1722 - DNA, 14 bp, Artificial Sequence
  Antisense nucleotide
gtcagtcacctgag

SEQ ID NO: 1723 - DNA, 15 bp, Artificial Sequence
  Antisense nucleotide
caggtcagtcacctg

SEQ ID NO: 1724 - DNA, 15 bp, Artificial Sequence
  Antisense nucleotide
cagcaggtcagtcac

SEQ ID NO: 1725 - DNA, 14 bp, Artificial Sequence
  Antisense nucleotide
gcagcaggtcagtc

SEQ ID NO: 1726 - DNA, 17 bp, Artificial Sequence
  Antisense nucleotide
catttagcagcaaggtc

SEQ ID NO: 1727 - DNA, 15 bp, Artificial Sequence
  Antisense nucleotide
gcagcatttagcagc

SEQ ID NO: 1728 - DNA, 15 bp, Artificial Sequence
  Antisense nucleotide
ctgagcagcatttag

SEQ ID NO: 1729 - DNA, 14 bp, Artificial Sequence
  Antisense nucleotide
cccatgagaatcct

SEQ ID NO: 1730 - DNA, 17 bp, Artificial Sequence
  Antisense nucleotide
ccttcccatgagaatcc

SEQ ID NO: 1731 - DNA, 14 bp, Artificial Sequence
  Antisense nucleotide
tcctccccttccca

SEQ ID NO: 1732 - DNA, 14 bp, Artificial Sequence
  Antisense nucleotide
gcctccagtagacc

SEQ ID NO: 1733 - DNA, 14 bp, Artificial Sequence
  Antisense nucleotide
gtcagacagggcct

SEQ ID NO: 1734 - DNA, 14 bp, Artificial Sequence
  Antisense nucleotide
ccatgtcagacagg

SEQ ID NO: 1735 - DNA, 14 bp, Artificial Sequence
  Antisense nucleotide
ggcccatgtcagac

SEQ ID NO: 1736 - DNA, 17 bp, Artificial Sequence
  Antisense nucleotide
gctattcctgaaatcac

SEQ ID NO: 1737 - DNA, 17 bp, Artificial Sequence
  Antisense nucleotide
cctcttgtcttcttacc

SEQ ID NO: 1738 - DNA, 17 bp, Artificial Sequence
  Antisense nucleotide
ggagaagaaacctcttg

SEQ ID NO: 1739 - DNA, 17 bp, Artificial Sequence
  Antisense nucleotide
ccttgctgaagtttctt

SEQ ID NO: 1740 - DNA, 14 bp, Artificial Sequence
  Antisense nucleotide
ccaagactccttgc

SEQ ID NO: 1741 - DNA, 14 bp, Artificial Sequence
  Antisense nucleotide
ccctttcatggagc

SEQ ID NO: 1742 - DNA, 14 bp, Artificial Sequence
  Antisense nucleotide
cctcttggtgtgac

SEQ ID NO: 1743 - DNA, 14 bp, Artificial Sequence
  Antisense nucleotide
gactaaggatgccg

SEQ ID NO: 1744 - DNA, 15 bp, Artificial Sequence
  Antisense nucleotide
gtggcaggactaagg

SEQ ID NO: 1745 - DNA, 14 bp, Artificial Sequence
  Antisense nucleotide
agacgtggcaggac

SEQ ID NO: 1746 - DNA, 14 bp, Artificial Sequence
  Antisense nucleotide
cttccagcaggcag

SEQ ID NO: 1747 - DNA, 14 bp, Artificial Sequence
  Antisense nucleotide
gttcctctgcctgg

SEQ ID NO: 1748 - DNA, 16 bp, Artificial Sequence
  Antisense nucleotide
gatgttcctctgcctg

SEQ ID NO: 1749 - DNA, 16 bp, Artificial Sequence
  Antisense nucleotide
gagatgttcctctgcc

SEQ ID NO: 1750 - DNA, 16 bp, Artificial Sequence
  Antisense nucleotide
gtgagatgttcctctg

SEQ ID NO: 1751 - DNA, 18 bp, Artificial Sequence
  Antisense nucleotide
cagagagtgagatgttcc

SEQ ID NO: 1752 - DNA, 18 bp, Artificial Sequence
  Antisense nucleotide
ccagagagtgagatgttc

SEQ ID NO: 1753 - DNA, 15 bp, Artificial Sequence
  Antisense nucleotide
ggtccagagagtgag

SEQ ID NO: 1754 - DNA, 15 bp, Artificial Sequence
  Antisense nucleotide
gaggtccagagagtg

SEQ ID NO: 1755 - DNA, 14 bp, Artificial Sequence
  Antisense nucleotide
ggtcctgtagtgcc

SEQ ID NO: 1756 - DNA, 17 bp, Artificial Sequence
  Antisense nucleotide
gattttatgatgcaggc

SEQ ID NO: 1757 - DNA, 18 bp, Artificial Sequence
  Antisense nucleotide
gacctgcatcccttattg

SEQ ID NO: 1758 - DNA, 18 bp, Artificial Sequence
  Antisense nucleotide
tagttgattttccagcag

SEQ ID NO: 1759 - DNA, 16 bp, Artificial Sequence
  Antisense nucleotide
gaatctcacgttttgc

SEQ ID NO: 1760 - DNA, 18 bp, Artificial Sequence
  Antisense nucleotide
cagagaaagaatctcacg

SEQ ID NO: 1761 - DNA, 18 bp, Artificial Sequence
  Antisense nucleotide
tttcaccatcagagaaag

SEQ ID NO: 1762 - DNA, 17 bp, Artificial Sequence
  Antisense nucleotide
catttggacatttcacc

SEQ ID NO: 1763 - DNA, 18 bp, Artificial Sequence
  Antisense nucleotide
ccttcatttggacatttc

SEQ ID NO: 1764 - DNA, 18 bp, Artificial Sequence
  Antisense nucleotide
caatgtgcttgatgatcc

SEQ ID NO: 1765 - DNA, 15 bp, Artificial Sequence
  Antisense nucleotide
cgcatcggatttctc

SEQ ID NO: 1766 - DNA, 18 bp, Artificial Sequence
  Antisense nucleotide
caaaccgcatcggatttc

SEQ ID NO: 1767 - DNA, 14 bp, Artificial Sequence
  Antisense nucleotide
gaactgcaaaccgc

SEQ ID NO: 1768 - DNA, 15 bp, Artificial Sequence
  Antisense nucleotide
gcagagaagaactgc

SEQ ID NO: 1769 - DNA, 15 bp, Artificial Sequence
  Antisense nucleotide
gcaagtaaacatggg

SEQ ID NO: 1770 - DNA, 14 bp, Artificial Sequence
  Antisense nucleotide
ggtccacgttttgg

SEQ ID NO: 1771 - DNA, 16 bp, Artificial Sequence
  Antisense nucleotide
gcaagggtccacgttt

SEQ ID NO: 1772 - DNA, 17 bp, Artificial Sequence
  Antisense nucleotide
tggcttcttcttcaggg

SEQ ID NO: 1773 - DNA, 16 bp, Artificial Sequence
  Antisense nucleotide
tcctgctggcttcttc

SEQ ID NO: 1774 - DNA, 14 bp, Artificial Sequence
  Antisense nucleotide
gtcctgctggcttc

SEQ ID NO: 1775 - DNA, 17 bp, Artificial Sequence
  Antisense nucleotide
ggtagtctaggaattgg

SEQ ID NO: 1776 - DNA, 17 bp, Artificial Sequence
  Antisense nucleotide
cttgcaggtagtctagg

SEQ ID NO: 1777 - DNA, 17 bp, Artificial Sequence
  Antisense nucleotide
gaaactcttgcaggtag

SEQ ID NO: 1778 - DNA, 17 bp, Artificial Sequence
  Antisense nucleotide
caccaagaaactcttgc

SEQ ID NO: 1779 - DNA, 18 bp, Artificial Sequence
  Antisense nucleotide
cattacaccaagaaactc

SEQ ID NO: 1780 - DNA, 18 bp, Artificial Sequence
  Antisense nucleotide
ctcggtgttcattacacc

SEQ ID NO: 1781 - DNA, 18 bp, Artificial Sequence
  Antisense nucleotide
ctttctattatccactcg

SEQ ID NO: 1782 - DNA, 18 bp, Artificial Sequence
  Antisense nucleotide
ccagtttagtctcaactt

SEQ ID NO: 1783 - DNA, 18 bp, Artificial Sequence
  Antisense nucleotide
aaccagtttagtctcaac

SEQ ID NO: 1784 - DNA, 18 bp, Artificial Sequence
  Antisense nucleotide
acaaaccagtttagtctc

SEQ ID NO: 1785 - DNA, 18 bp, Artificial Sequence
  Antisense nucleotide
ctcgcgaaaaagtttctt

SEQ ID NO: 1786 - DNA, 18 bp, Artificial Sequence
  Antisense nucleotide
ccctcgcgaaaaagtttc

SEQ ID NO: 1787 - DNA, 16 bp, Artificial Sequence
  Antisense nucleotide
gtccctcgcgaaaaag

SEQ ID NO: 1788 - DNA, 15 bp, Artificial Sequence
  Antisense nucleotide
cagttgaaccgtccc

SEQ ID NO: 1789 - DNA, 18 bp, Artificial Sequence
  Antisense nucleotide
gctttcgaagtttcagtt

SEQ ID NO: 1790 - DNA, 17 bp, Artificial Sequence
  Antisense nucleotide
gatgctttcgaagtttc

SEQ ID NO: 1791 - DNA, 18 bp, Artificial Sequence
  Antisense nucleotide
ctgtctctgcaaataatg

SEQ ID NO: 1792 - DNA, 18 bp, Artificial Sequence
  Antisense nucleotide
cacttattacattcaccc

SEQ ID NO: 1793 - DNA, 17 bp, Artificial
  Antisense nucleotide
ttttcctccagttcctc

SEQ ID NO: 1794 - DNA, 20 bp, Artificial Sequence
  Antisense nucleotide
ggacaatatgtacaaaactc

SEQ ID NO: 1795 - DNA, 18 bp, Artificial Sequence
  Antisense nucleotide
gttgatgaacatttggac

SEQ ID NO: 1796 - DNA, 18 bp, Artificial Sequence
  Antisense nucleotide
gtgttgatgaacatttgg

SEQ ID NO: 1797 - DNA, 16 bp, Artificial Sequence
  Antisense nucleotide
caaaatttggccaggg

SEQ ID NO: 1798 - DNA, 15 bp, Artificial Sequence
  Antisense nucleotide
gcccaaaatttggcc

SEQ ID NO: 1799 - DNA, 17 bp, Artificial Sequence
  Antisense nucleotide
cccagcccaaaatttgg

SEQ ID NO: 1800 - DNA, 17 bp, Artificial Sequence
  Antisense nucleotide
gtccccagcccaaaatt

SEQ ID NO: 1801 - DNA, 16 bp, Artificial Sequence
  Antisense nucleotide
aaatcgccagaggctg

SEQ ID NO: 1802 - DNA, 16 bp, Artificial Sequence
  Antisense nucleotide
accaaatcgccagagg

SEQ ID NO: 1803 - DNA, 17 bp, Artificial Sequence
  Antisense nucleotide
catcaccaaatcgccag

SEQ ID NO: 1804 - DNA, 16 bp, Artificial Sequence
  Antisense nucleotide
taggagtggttgaggc

SEQ ID NO: 1805 - DNA, 17 bp, Artificial Sequence
  Antisense nucleotide
gtgtaggagtggttgag

SEQ ID NO: 1806 - DNA, 14 bp, Artificial Sequence
  Antisense nucleotide
ctgtgtaggagtgg

SEQ ID NO: 1807 - DNA, 14 bp, Artificial Sequence
  Antisense nucleotide
cccacatgcctgtg

SEQ ID NO: 1808 - DNA, 14 bp, Artificial Sequence
  Antisense nucleotide
cgatgaacaacgag

SEQ ID NO: 1809 - DNA, 16 bp, Artificial Sequence
  Antisense nucleotide
ctggcgatgaacaacg

SEQ ID NO: 1810 - DNA, 14 bp, Artificial Sequence
  Antisense nucleotide
cgctggcgatgaac

SEQ ID NO: 1811 - DNA, 15 bp, Artificial Sequence
  Antisense nucleotide
gagctagtcccgttg

SEQ ID NO: 1812 - DNA, 15 bp, Artificial Sequence
  Antisense nucleotide
gcgaagagctagtcc

SEQ ID NO: 1813 - DNA, 17 bp, Artificial Sequence
  Antisense nucleotide
ccagttatgcgaagagc

SEQ ID NO: 1814 - DNA, 16 bp, Artificial Sequence
  Antisense nucleotide
ccccagttatgcgaag

SEQ ID NO: 1815 - DNA, 14 bp, Artificial Sequence
  Antisense nucleotide
cacatgcttggcgc

SEQ ID NO: 1816 - DNA, 16 bp, Artificial Sequence
  Antisense nucleotide
gatcacatgcttggcg

SEQ ID NO: 1817 - DNA, 18 bp, Artificial Sequence
  Antisense nucleotide
gacaaagagcatgatcac

SEQ ID NO: 1818 - DNA, 17 bp, Artificial Sequence
  Antisense nucleotide
gagtcacagggacaaag

SEQ ID NO: 1819 - DNA, 15 bp, Artificial Sequence
  Antisense nucleotide
gagagtcacagggac

SEQ ID NO: 1820 - DNA, 15 bp, Artificial Sequence
  Antisense nucleotide
gcagagagtcacagg

SEQ ID NO: 1821 - DNA, 14 bp, Artificial Sequence
  Antisense nucleotide
ccatgcagagagtc

SEQ ID NO: 1822 - DNA, 15 bp, Artificial Sequence
  Antisense nucleotide
ccaccatgcagagag

SEQ ID NO: 1823 - DNA, 14 bp, Artificial Sequence
  Antisense nucleotide
tagccacgaccacc

SEQ ID NO: 1824 - DNA, 18 bp, Artificial Sequence
  Antisense nucleotide
gattagctgcccatcctt

SEQ ID NO: 1825 - DNA, 17 bp, Artificial Sequence
  Antisense nucleotide
ggtatagattagctgcc

SEQ ID NO: 1826 - DNA, 18 bp, Artificial Sequence
  Antisense nucleotide
gtatcttctgtgaatggg

SEQ ID NO: 1827 - DNA, 14 bp, Artificial Sequence
  Antisense nucleotide
ctggcccacagtct

SEQ ID NO: 1828 - DNA, 14 bp, Artificial Sequence
  Antisense nucleotide
ctctggcccacagt

SEQ ID NO: 1829 - DNA, 14 bp, Artificial Sequence
  Antisense nucleotide
tgcagggctctctg

SEQ ID NO: 1830 - DNA, 14 bp, Artificial Sequence
  Antisense nucleotide
agtgcagggctctc

SEQ ID NO: 1831 - DNA, 16 bp, Artificial Sequence
  Antisense nucleotide
cactgatcatgatggc

SEQ ID NO: 1832 - DNA, 18 bp, Artificial Sequence
  Antisense nucleotide
gacactgatcatgatggc

SEQ ID NO: 1833 - DNA, 18 bp, Artificial Sequence
  Antisense nucleotide
acaatgacactgatcatg

SEQ ID NO: 1834 - DNA, 16 bp, Artificial Sequence
  Antisense nucleotide
gaaccaccaggaggat

SEQ ID NO: 1835 - DNA, 17 bp, Artificial Sequence
  Antisense nucleotide
gacacaaaacagccact

SEQ ID NO: 1836 - DNA, 15 bp, Artificial Sequence
  Antisense nucleotide
gtggacctttcggac

SEQ ID NO: 1837 - DNA, 17 bp, Artificial Sequence
  Antisense nucleotide
caaccagcatacgaagt

SEQ ID NO: 1838 - DNA, 14 bp, Artificial Sequence
  Antisense nucleotide
tccctctgggcttc

SEQ ID NO: 1839 - DNA, 14 bp, Artificial Sequence
  Antisense nucleotide
actgtccctctggg

SEQ ID NO: 1840 - DNA, 14 bp, Artificial Sequence
  Antisense nucleotide
gactgtccctctgg

SEQ ID NO: 1841 - DNA, 16 bp, Artificial Sequence
  Antisense nucleotide
cctagatgactgtccc

SEQ ID NO: 1842 - DNA, 15 bp, Artificial Sequence
  Antisense nucleotide
cagcgaggatactgc

SEQ ID NO: 1843 - DNA, 16 bp, Artificial Sequence
  Antisense nucleotide
cttcaccagcgaggat

SEQ ID NO: 1844 - DNA, 18 bp, Artificial Sequence
  Antisense nucleotide
tttcctctgggtcttcac

SEQ ID NO: 1845 - DNA, 17 bp, Artificial Sequence
  Antisense nucleotide
ctttcctctgggtcttc

SEQ ID NO: 1846 - DNA, 17 bp, Artificial Sequence
  Antisense nucleotide
ctcccaatccaagtttt

SEQ ID NO: 1847 - DNA, 14 bp, Artificial Sequence
  Antisense nucleotide
ttcatcccggagcc

SEQ ID NO: 1848 - DNA, 16 bp, Artificial Sequence
  Antisense nucleotide
ttcttcatcccggagc

SEQ ID NO: 1849 - DNA, 16 bp, Artificial Sequence
  Antisense nucleotide
gctcagccagttcttc

SEQ ID NO: 1850 - DNA, 14 bp, Artificial Sequence
  Antisense nucleotide
gacagagagggcac

SEQ ID NO: 1851 - DNA, 15 bp, Artificial Sequence
  Antisense nucleotide
cttcacctccgacag

SEQ ID NO: 1852 - DNA, 16 bp, Artificial Sequence
  Antisense nucleotide
gaaaagtctgggcagg

SEQ ID NO: 1853 - DNA, 18 bp, Artificial Sequence
  Antisense nucleotide
gaccctggaacagaaaag

SEQ ID NO: 1854 - DNA, 15 bp, Artificial Sequence
  Antisense nucleotide
ctgaccctggaacag

SEQ ID NO: 1855 - DNA, 16 bp, Artificial Sequence
  Antisense nucleotide
actacaggctgaccct

SEQ ID NO: 1856 - DNA, 18 bp, Artificial Sequence
  Antisense nucleotide
attcactacaggctgacc

SEQ ID NO: 1857 - DNA, 14 bp, Artificial Sequence
  Antisense nucleotide
cgattcactacagg

SEQ ID NO: 1858 - DNA, 14 bp, Artificial Sequence
  Antisense nucleotide
ggccgattcactac

SEQ ID NO: 1859 - DNA, 16 bp, Artificial Sequence
  Antisense nucleotide
cgaacgtctgttggtc

SEQ ID NO: 1860 - DNA, 15 bp, Artificial Sequence
  Antisense nucleotide
cgcgaacgtctgttg

SEQ ID NO: 1861 - DNA, 18 bp, Artificial Sequence
  Antisense nucleotide
cttctgtttgtcgaggat

SEQ ID NO: 1862 - DNA, 18 bp, Artificial Sequence
  Antisense nucleotide
ttcaccaccttctgtttg

SEQ ID NO: 1863 - DNA, 18 bp, Artificial Sequence
  Antisense nucleotide
aggatgcgcttttcattc

SEQ ID NO: 1864 - DNA, 15 bp, Artificial Sequence
  Antisense nucleotide
agcttgcaggatgcg

SEQ ID NO: 1865 - DNA, 18 bp, Artificial Sequence
  Antisense nucleotide
gttgacagcttgcaggat

SEQ ID NO: 1866 - DNA, 18 bp, Artificial Sequence
  Antisense nucleotide
ggaacggaaagttgacag

SEQ ID NO: 1867 - DNA, 18 bp, Artificial Sequence
  Antisense nucleotide
aactcgagtttgacgagg

SEQ ID NO: 1868 - DNA, 17 bp, Artificial Sequence
  Antisense nucleotide
tgtccttgaaggagaac

SEQ ID NO: 1869 - DNA, 18 bp, Artificial Sequence
  Antisense nucleotide
cgtactccatgaccatgt

SEQ ID NO: 1870 - DNA, 16 bp, Artificial Sequence
  Antisense nucleotide
gcacgtactccatgac

SEQ ID NO: 1871 - DNA, 16 bp, Artificial Sequence
  Antisense nucleotide
gattctccggcttcag

SEQ ID NO: 1872 - DNA, 18 bp, Artificial
  Antisense nucleotide
tcaatgagcagattctcc

SEQ ID NO: 1873 - DNA, 17 bp, Artificial Sequence
  Antisense nucleotide
ggtcaatgagcagattc

SEQ ID NO: 1874 - DNA, 15 bp, Artificial Sequence
  Antisense nucleotide
ccctgctggtcaatg

SEQ ID NO: 1875 - DNA, 14 bp, Artificial Sequence
  Antisense nucleotide
tagccctgctggtc

SEQ ID NO: 1876 - DNA, 14 bp, Artificial Sequence
  Antisense nucleotide
cgcttggcgaaacc

SEQ ID NO: 1877 - DNA, 14 bp, Artificial Sequence
  Antisense nucleotide
ccttcacgcgcttg

SEQ ID NO: 1878 - DNA, 14 bp, Artificial Sequence
  Antisense nucleotide
aaggtccaagtgcg

SEQ ID NO: 1879 - DNA, 14 bp, Artificial Sequence
  Antisense nucleotide
tgccgcacaaggtc

SEQ ID NO: 1880 - DNA, 17 bp, Artificial Sequence
  Antisense nucleotide
ggtgaggaccaccattt

SEQ ID NO: 1881 - DNA, 14 bp, Artificial Sequence
  Antisense nucleotide
gggtgtcacaggtg

SEQ ID NO: 1882 - DNA, 18 bp, Artificial Sequence
  Antisense nucleotide
ataccatcttcttcaggg

SEQ ID NO: 1883 - DNA, 18 bp, Artificial Sequence
  Antisense nucleotide
ggtgataccatcttcttc

SEQ ID NO: 1884 - DNA, 18 bp, Artificial Sequence
  Antisense nucleotide
ccaggtgataccatcttc

SEQ ID NO: 1885 - DNA, 15 bp, Artificial Sequence
  Antisense nucleotide
cctcactgctctggt

SEQ ID NO: 1886 - DNA, 14 bp, Artificial Sequence
  Antisense nucleotide
taagacctcactgc

SEQ ID NO: 1887 - DNA, 16 bp, Artificial Sequence
  Antisense nucleotide
cagagcctaagacctc

SEQ ID NO: 1888 - DNA, 15 bp, Artificial Sequence
  Antisense nucleotide
ccagagcctaagacc

SEQ ID NO: 1889 - DNA, 18 bp, Artificial Sequence
  Antisense nucleotide
tcttcctttttgtgaagc

SEQ ID NO: 1890 - DNA, 18 bp, Artificial Sequence
  Antisense nucleotide
gaccaaattccatcttcc

SEQ ID NO: 1891 - DNA, 18 bp, Artificial Sequence
  Antisense nucleotide
atcagtggaccaaattcc

SEQ ID NO: 1892 - DNA, 18 bp, Artificial Sequence
  Antisense nucleotide
ggttctttctggtccttt

SEQ ID NO: 1893 - DNA, 18 bp, Artificial Sequence
  Antisense nucleotide
tttttgggttctttctgg

SEQ ID NO: 1894 - DNA, 18 bp, Artificial Sequence
  Antisense nucleotide
ggtcttatttttgggttc

SEQ ID NO: 1895 - DNA, 17 bp, Artificial Sequence
  Antisense nucleotide
aatgggcagactctcct

SEQ ID NO: 1896 - DNA, 18 bp, Artificial Sequence
  Antisense nucleotide
tccaccatgacctcaatg

SEQ ID NO: 1897 - DNA, 16 bp, Artificial Sequence
  Antisense nucleotide
aacggcatccaccatg

SEQ ID NO: 1898 - DNA, 15 bp, Artificial Sequence
  Antisense nucleotide
gtgaacggcatccac

SEQ ID NO: 1899 - DNA, 18 bp, Artificial Sequence
  Antisense nucleotide
acttgagcttgtgaacgg

SEQ ID NO: 1900 - DNA, 18 bp, Artificial Sequence
  Antisense nucleotide
ttcatacttgagcttgtg

SEQ ID NO: 1901 - DNA, 18 bp, Artificial Sequence
  Antisense nucleotide
ctggtgtagttttcatac

SEQ ID NO: 1902 - DNA, 18 bp, Artificial Sequence
  Antisense nucleotide
agctgctggtgtagtttt

SEQ ID NO: 1903 - DNA, 14 bp, Artificial Sequence
  Antisense nucleotide
aggaggaccagggt

SEQ ID NO: 1904 - DNA, 14 bp, Artificial Sequence
  Antisense nucleotide
aggtggtccaggag

SEQ ID NO: 1905 - DNA, 18 bp, Artificial Sequence
  Antisense nucleotide
tttctggccaaactgagg

SEQ ID NO: 1906 - DNA, 14 bp, Artificial Sequence
  Antisense nucleotide
ggaggtttctggcc

SEQ ID NO: 1907 - DNA, 14 bp, Artificial Sequence
  Antisense nucleotide
tctggagtggccac

SEQ ID NO: 1908 - DNA, 18 bp, Artificial Sequence
  Antisense nucleotide
cttctggagcatgttgct

SEQ ID NO: 1909 - DNA, 15 bp, Artificial Sequence
  Antisense nucleotide
gccttctggagcatg

SEQ ID NO: 1910 - DNA, 17 bp, Artificial Sequence
  Antisense nucleotide
gtttgtctggccttctg

SEQ ID NO: 1911 - DNA, 18 bp, Artificial Sequence
  Antisense nucleotide
gagtttgtctggccttct

SEQ ID NO: 1912 - DNA, 18 bp, Artificial Sequence
  Antisense nucleotide
ctagagtttgtctggcct

SEQ ID NO: 1913 - DNA, 18 bp, Artificial Sequence
  Antisense nucleotide
gcaagggtaaaattctag

SEQ ID NO: 1914 - DNA, 18 bp, Artificial Sequence
  Antisense nucleotide
agtgcaagggtaaaattc

SEQ ID NO: 1915 - DNA, 15 bp, Artificial Sequence
  Antisense nucleotide
aaacaggcctccact

SEQ ID NO: 1916 - DNA, 18 bp, Artificial Sequence
  Antisense nucleotide
cttggttaattccaatgg

SEQ ID NO: 1917 - DNA, 18 bp, Artificial Sequence
  Antisense nucleotide
aggcaactcccattagtt

SEQ ID NO: 1918 - DNA, 18 bp, Artificial Sequence
  Antisense nucleotide
tactactaaggcacaggg

SEQ ID NO: 1919 - DNA, 18 bp, Artificial Sequence
  Antisense nucleotide
aatactactaaggcacag

SEQ ID NO: 1920 - DNA, 18 bp, Artificial Sequence
  Antisense nucleotide
gtacatcttcaagtcttc

SEQ ID NO: 1921 - DNA, 14 bp, Artificial Sequence
  Antisense nucleotide
ggagtggacatgat

SEQ ID NO: 1922 - DNA, 18 bp, Artificial Sequence
  Antisense nucleotide
aagaagatgaagcctttg

SEQ ID NO: 1923 - DNA, 18 bp, Artificial Sequence
  Antisense nucleotide
ccgtcttactcttcttgg

SEQ ID NO: 1924 - DNA, 17 bp, Artificial Sequence
  Antisense nucleotide
ccgatacaattccaagg

SEQ ID NO: 1925 - DNA, 15 bp, Artificial Sequence
  Antisense nucleotide
ccttttccttctgag

SEQ ID NO: 1926 - DNA, 14 bp, Artificial Sequence
  Antisense nucleotide
ctgttgcaagtacg

SEQ ID NO: 1927 - DNA, 14 bp, Artificial Sequence
  Antisense nucleotide
cagaagcagagggc

SEQ ID NO: 1928 - DNA, 15 bp, Artificial Sequence
  Antisense nucleotide
cctcagaagcagagg

SEQ ID NO: 1929 - DNA, 14 bp, Artificial Sequence
  Antisense nucleotide
ctcctcagaagcag

SEQ ID NO: 1930 - DNA, 14 bp, Artificial Sequence
  Antisense nucleotide
acaggctggtggca

SEQ ID NO: 1931 - DNA, 16 bp, Artificial Sequence
  Antisense nucleotide
ccactctcaaacaggc

SEQ ID NO: 1932 - DNA, 14 bp, Artificial Sequence
  Antisense nucleotide
acggtagccgaagc

SEQ ID NO: 1933 - DNA, 15 bp, Artificial Sequence
  Antisense nucleotide
gacggtagccgaagc

SEQ ID NO: 1934 - DNA, 14 bp, Artificial Sequence
  Antisense nucleotide
ggccagacggtagc

SEQ ID NO: 1935 - DNA, 18 bp, Artificial Sequence
  Antisense nucleotide
gtgtagggccagacggta

SEQ ID NO: 1936 - DNA, 18 bp, Artificial Sequence
  Antisense nucleotide
ccgaagccatttttcagg

SEQ ID NO: 1937 - DNA, 17 bp, Artificial Sequence
  Antisense nucleotide
ccccgaagccatttttc

SEQ ID NO: 1938 - DNA, 14 bp, Artificial Sequence
  Antisense nucleotide
ggttgatgtcgtcc

SEQ ID NO: 1939 - DNA, 15 bp, Artificial Sequence
  Antisense nucleotide
gcttgagacactcgc

SEQ ID NO: 1940 - DNA, 14 bp, Artificial Sequence
  Antisense nucleotide
ccggacccgtccat

SEQ ID NO: 1941 - DNA, 14 bp, Artificial Sequence
  Antisense nucleotide
gcttgctttactgc

SEQ ID NO: 1942 - DNA, 14 bp, Artificial Sequence
  Antisense nucleotide
ggttgctctgagac

SEQ ID NO: 1943 - DNA, 14 bp, Artificial Sequence
  Antisense nucleotide
gccacagtcatgcc

SEQ ID NO: 1944 - DNA, 14 bp, Artificial Sequence
  Antisense nucleotide
cgggcatgctggcg

SEQ ID NO: 1945 - DNA, 18 bp, Artificial Sequence
  Antisense nucleotide
gtgaagttcaggatgatc

SEQ ID NO: 1946 - DNA, 14 bp, Artificial Sequence
  Antisense nucleotide
ccagtgcctcatgg

SEQ ID NO: 1947 - DNA, 15 bp, Artificial Sequence
  Antisense nucleotide
cagtgttctccatgg

SEQ ID NO: 1948 - DNA, 15 bp, Artificial Sequence
  Antisense nucleotide
ctgtaccagaccgag

SEQ ID NO: 1949 - DNA, 15 bp, Artificial Sequence
  Antisense nucleotide
gcatactgtttcagc

SEQ ID NO: 1950 - DNA, 15 bp, Artificial Sequence
  Antisense nucleotide
gccatcagctccttg

SEQ ID NO: 1951 - DNA, 15 bp, Artificial Sequence
  Antisense nucleotide
ccacaccatagatgg

SEQ ID NO: 1952 - DNA, 15 bp, Artificial Sequence
  Antisense nucleotide
gctggagcagtttcc

SEQ ID NO: 1953 - DNA, 14 bp, Artificial Sequence
  Antisense nucleotide
ctcgcttctgctgc

SEQ ID NO: 1954 - DNA, 14 bp, Artificial Sequence
  Antisense nucleotide
accgtggcaaagcg

SEQ ID NO: 1955 - DNA, 14 bp, Artificial Sequence
  Antisense nucleotide
aggtgacaccgtgg

SEQ ID NO: 1956 - DNA, 16 bp, Artificial Sequence
  Antisense nucleotide
gacttgattccttcag

SEQ ID NO: 1957 - DNA, 17 bp, Artificial Sequence
  Antisense nucleotide
ggatttgacttgattcc

SEQ ID NO: 1958 - DNA, 14 bp, Artificial Sequence
  Antisense nucleotide
gctgctgttcatgg

SEQ ID NO: 1959 - DNA, 17 bp, Artificial Sequence
  Antisense nucleotide
ccgtttctttcagtagg

SEQ ID NO: 1960 - DNA, 14 bp, Artificial Sequence
  Antisense nucleotide
cttgaagtaggagc

SEQ ID NO: 1961 - DNA, 14 bp, Artificial Sequence
  Antisense nucleotide
cgctcctacatggc

SEQ ID NO: 1962 - DNA, 15 bp, Artificial Sequence
  Antisense nucleotide
gatgaggtacaggcc

SEQ ID NO: 1963 - DNA, 15 bp, Artificial Sequence
  Antisense nucleotide
gtagatgaggtacag

SEQ ID NO: 1964 - DNA, 15 bp, Artificial Sequence
  Antisense nucleotide
gagtagatgaggtac

SEQ ID NO: 1965 - DNA, 14 bp, Artificial Sequence
  Antisense nucleotide
cctgggagtagatg

SEQ ID NO: 1966 - DNA, 14 bp, Artificial Sequence
  Antisense nucleotide
ggacctgggagtag

SEQ ID NO: 1967 - DNA, 14 bp, Artificial Sequence
  Antisense nucleotide
acatgggtggaggg

SEQ ID NO: 1968 - DNA, 14 bp, Artificial Sequence
  Antisense nucleotide
gtgctcatggtgtc

SEQ ID NO: 1969 - DNA, 15 bp, Artificial Sequence
  Antisense nucleotide
ctttcagtgctcatg

SEQ ID NO: 1970 - DNA, 15 bp, Artificial Sequence
  Antisense nucleotide
tgctttcagtgctca

SEQ ID NO: 1971 - DNA, 15 bp, Artificial Sequence
  Antisense nucleotide
gatgatctgactgcc

SEQ ID NO: 1972 - DNA, 16 bp, Artificial Sequence
  Antisense nucleotide
gttcgagaagatgatc

SEQ ID NO: 1973 - DNA, 15 bp, Artificial Sequence
  Antisense nucleotide
gggttcgagaagatg

SEQ ID NO: 1974 - DNA, 16 bp, Artificial Sequence
  Antisense nucleotide
ggtttgctacaacatg

SEQ ID NO: 1975 - DNA, 15 bp, Artificial Sequence
  Antisense nucleotide
cagcttgagggtttg

SEQ ID NO: 1976 - DNA, 14 bp, Artificial Sequence
  Antisense nucleotide
tgcccctcagcttg

SEQ ID NO: 1977 - DNA, 15 bp, Artificial Sequence
  Antisense nucleotide
gacacacactatctc

SEQ ID NO: 1978 - DNA, 16 bp, Artificial Sequence
  Antisense nucleotide
gcagccatctttattc

SEQ ID NO: 1979 - DNA, 14 bp, Artificial Sequence
  Antisense nucleotide
gttcagcagccatc

SEQ ID NO: 1980 - DNA, 14 bp, Artificial Sequence
  Antisense nucleotide
tggttcagcagcca

SEQ ID NO: 1981 - DNA, 16 bp, Artificial Sequence
  Antisense nucleotide
ctactggttcagcagc

SEQ ID NO: 1982 - DNA, 14 bp, Artificial Sequence
  Antisense nucleotide
tctactggttcagc

SEQ ID NO: 1983 - DNA, 16 bp, Artificial Sequence
  Antisense nucleotide
gccacaaagttgatgc

SEQ ID NO: 1984 - DNA, 16 bp, Artificial Sequence
  Antisense nucleotide
cattgccacaaagttg

SEQ ID NO: 1985 - DNA, 16 bp, Artificial Sequence
  Antisense nucleotide
gagaacttggtcattc

SEQ ID NO: 1986 - DNA, 16 bp, Artificial Sequence
  Antisense nucleotide
ggtcaatgaagagaac

SEQ ID NO: 1987 - DNA, 14 bp, Artificial Sequence
  Antisense nucleotide
cgatttccttggtc

SEQ ID NO: 1988 - DNA, 15 bp, Artificial Sequence
  Antisense nucleotide
ccgatttccttggtc

SEQ ID NO: 1989 - DNA, 18 bp, Artificial Sequence
  Antisense nucleotide
caaatagaggccgatttc

SEQ ID NO: 1990 - DNA, 14 bp, Artificial Sequence
  Antisense nucleotide
caaatagaggccga

SEQ ID NO: 1991 - DNA, 14 bp, Artificial Sequence
  Antisense nucleotide
cctctaggctggct

SEQ ID NO: 1992 - DNA, 15 bp, Artificial Sequence
  Antisense nucleotide
catacctctaggctg

SEQ ID NO: 1993 - DNA, 14 bp, Artificial Sequence
  Antisense nucleotide
agccatacctctag

SEQ ID NO: 1994 - DNA, 15 bp, Artificial Sequence
  Antisense nucleotide
cagccatacctctag

SEQ ID NO: 1995 - DNA, 17 bp, Artificial Sequence
  Antisense nucleotide
cacagagatagttacag

SEQ ID NO: 1996 - DNA, 17 bp, Artificial Sequence
  Antisense nucleotide
gtcttcgttttgaacag

SEQ ID NO: 1997 - DNA, 18 bp, Artificial Sequence
  Antisense nucleotide
ctagtcttcgttttgaac

SEQ ID NO: 1998 - DNA, 18 bp, Artificial Sequence
  Antisense nucleotide
tagctagtcttcgttttg

SEQ ID NO: 1999 - DNA, 13 bp, Artificial Sequence
  Antisense nucleotide
gagccactgcgcc

SEQ ID NO: 2000 - DNA, 14 bp, Artificial Sequence
  Antisense nucleotide
cgtgagccactgcg

SEQ ID NO: 2001 - DNA, 15 bp, Artificial Sequence
  Antisense nucleotide
cgtaacgatcactgg

SEQ ID NO: 2002 - DNA, 15 bp, Artificial Sequence
  Antisense nucleotide
gcactcgtaacgatc

SEQ ID NO: 2003 - DNA, 14 bp, Artificial Sequence
  Antisense nucleotide
ggagcactcgtaac

SEQ ID NO: 2004 - DNA, 14 bp, Artificial Sequence
  Antisense nucleotide
catcatcctgaggt

SEQ ID NO: 2005 - DNA, 16 bp, Artificial Sequence
  Antisense nucleotide
cagtatcatcatcctg

SEQ ID NO: 2006 - DNA, 16 bp, Artificial Sequence
  Antisense nucleotide
ctcagtatcatcatcc

SEQ ID NO: 2007 - DNA, 18 bp, Artificial Sequence
  Antisense nucleotide
ctaaaagtatgtgccatc

SEQ ID NO: 2008 - DNA, 14 bp, Artificial Sequence
  Antisense nucleotide
cacatcgcctctct

SEQ ID NO: 2009 - DNA, 18 bp, Artificial Sequence
  Antisense nucleotide
gcttcacagtcacatcgc

SEQ ID NO: 2010 - DNA, 16 bp, Artificial Sequence
  Antisense nucleotide
ggaaggcttcacagtc

SEQ ID NO: 2011 - DNA, 18 bp, Artificial Sequence
  Antisense nucleotide
cctgtgacttgagaattg

SEQ ID NO: 2012 - DNA, 14 bp, Artificial Sequence
  Antisense nucleotide
ggaagacctgtgac

SEQ ID NO: 2013 - DNA, 18 bp, Artificial Sequence
  Antisense nucleotide
ctctgctccacatatttg

SEQ ID NO: 2014 - DNA, 15 bp, Artificial Sequence
  Antisense nucleotide
caacgaagatctctg

SEQ ID NO: 2015 - DNA, 14 bp, Artificial Sequence
  Antisense nucleotide
caacaccaacgaag

SEQ ID NO: 2016 - DNA, 14 bp, Artificial Sequence
  Antisense nucleotide
ggtcttctgtttgc

SEQ ID NO: 2017 - DNA, 18 bp, Artificial Sequence
  Antisense nucleotide
cgatgaagtggtaggaag

SEQ ID NO: 2018 - DNA, 14 bp, Artificial Sequence
  Antisense nucleotide
ggttgcatggaagc

SEQ ID NO: 2019 - DNA, 15 bp, Artificial Sequence
  Antisense nucleotide
ggtcacaaacttgcc

SEQ ID NO: 2020 - DNA, 17 bp, Artificial Sequence
  Antisense nucleotide
ctgatttggtccactag

SEQ ID NO: 2021 - DNA, 16 bp, Artificial Sequence
  Antisense nucleotide
catgttagcactgttc

SEQ ID NO: 2022 - DNA, 16 bp, Artificial Sequence
  Antisense nucleotide
ggtcttgatgtactcc

SEQ ID NO: 2023 - DNA, 17 bp, Artificial Sequence
  Antisense nucleotide
ccacctaaagagagatc

SEQ ID NO: 2024 - DNA, 16 bp, Artificial Sequence
  Antisense nucleotide
cttgtactgcaccatc

SEQ ID NO: 2025 - DNA, 16 bp, Artificial Sequence
  Antisense nucleotide
gccagttaagaagatg

SEQ ID NO: 2026 - DNA, 17 bp, Artificial Sequence
  Antisense nucleotide
gagatcatgatccatgg

SEQ ID NO: 2027 - DNA, 17 bp, Artificial Sequence
  Antisense nucleotide
gtagtgtcccaatagtg

SEQ ID NO: 2028 - DNA, 16 bp, Artificial Sequence
  Antisense nucleotide
cttcctcatcattccc

SEQ ID NO: 2029 - DNA, 15 bp, Artificial Sequence
  Antisense nucleotide
cacaagcttttcgac

SEQ ID NO: 2030 - DNA, 18 bp, Artificial Sequence
  Antisense nucleotide
cggcatgtctattttgta

SEQ ID NO: 2031 - DNA, 20 bp, Artificial Sequence
  Antisense nucleotide
gctttcaccaaattggaagc

SEQ ID NO: 2032 - DNA, 14 bp, Artificial Sequence
  Antisense nucleotide
ctggcttttgggtt

SEQ ID NO: 2033 - DNA, 14 bp, Artificial Sequence
  Antisense nucleotide
cacacagtagtgca

SEQ ID NO: 2034 - DNA, 14 bp, Artificial Sequence
  Antisense nucleotide
gcacacagtagtgc

SEQ ID NO: 2035 - DNA, 17 bp, Artificial Sequence
  Antisense nucleotide
gcttgctcaggatctgc

SEQ ID NO: 2036 - DNA, 14 bp, Artificial Sequence
  Antisense nucleotide
tactcttcgtcgct

SEQ ID NO: 2037 - DNA, 14 bp, Artificial Sequence
  Antisense nucleotide
cttggcgtagtact

SEQ ID NO: 2038 - DNA, 14 bp, Artificial Sequence
  Antisense nucleotide
gtaaacctccttgg

SEQ ID NO: 2039 - DNA, 19 bp, Artificial Sequence
  Antisense nucleotide
gtctattttgtaaacctcc

SEQ ID NO: 2040 - DNA, 20 bp, Artificial Sequence
  Antisense nucleotide
gcatgtctattttgtaaacc

SEQ ID NO: 2041 - DNA, 14 bp, Artificial Sequence
  Antisense nucleotide
ggcatcaaggtacc

SEQ ID NO: 2042 - DNA, 14 bp, Artificial Sequence
  Antisense nucleotide
ctgtagaaagtggg

SEQ ID NO: 2043 - DNA, 18 bp, Artificial Sequence
  Antisense nucleotide
acaattctgaagtagggt

SEQ ID NO: 2044 - DNA, 18 bp, Artificial Sequence
  Antisense nucleotide
tcaccaaattggaagcat

SEQ ID NO: 2045 - DNA, 18 bp, Artificial Sequence
  Antisense nucleotide
tctgatatagctcaatcc

SEQ ID NO: 2046 - DNA, 18 bp, Artificial Sequence
  Antisense nucleotide
tcctagtggactttatag

SEQ ID NO: 2047 - DNA, 16 bp, Artificial Sequence
  Antisense nucleotide
tttttcctagtggact

SEQ ID NO: 2048 - DNA, 19 bp, Artificial Sequence
  Antisense nucleotide
caattatcctgcacatttc

SEQ ID NO: 2049 - DNA, 16 bp, Artificial Sequence
  Antisense nucleotide
gcaattatcctgcaca

SEQ ID NO: 2050 - DNA, 16 bp, Artificial Sequence
  Antisense nucleotide
gcagcaattatcctgc

SEQ ID NO: 2051 - DNA, 14 bp, Artificial Sequence
  Antisense nucleotide
tggcattgtaccct

SEQ ID NO: 2052 - DNA, 14 bp, Artificial Sequence
  Antisense nucleotide
tgtgctgagtgtct

SEQ ID NO: 2053 - DNA, 16 bp, Artificial Sequence
  Antisense nucleotide
cctgctgtgctgagtg

SEQ ID NO: 2054 - DNA, 14 bp, Artificial Sequence
  Antisense nucleotide
cttgggtgttttgc

SEQ ID NO: 2055 - DNA, 18 bp, Artificial Sequence
  Antisense nucleotide
tttagctgcatttgcaag

SEQ ID NO: 2056 - DNA, 14 bp, Artificial Sequence
  Antisense nucleotide
gccacttttccaag

SEQ ID NO: 2057 - DNA, 18 bp, Artificial Sequence
  Antisense nucleotide
ctgatgtgttgaagaaca

SEQ ID NO: 2058 - DNA, 14 bp, Artificial Sequence
  Antisense nucleotide
cgatagtcttgcag

SEQ ID NO: 2059 - DNA, 14 bp, Artificial Sequence
  Antisense nucleotide
gtcgatagtcttgc

SEQ ID NO: 2060 - DNA, 14 bp, Artificial Sequence
  Antisense nucleotide
cttggacaggatct

SEQ ID NO: 2061 - DNA, 14 bp, Artificial Sequence
  Antisense nucleotide
ccaggaattgttgc

SEQ ID NO: 2062 - DNA, 14 bp, Artificial Sequence
  Antisense nucleotide
cctcaatttcccct

SEQ ID NO: 2063 - DNA, 14 bp, Artificial Sequence
  Antisense nucleotide
gatgtccacttgca

SEQ ID NO: 2064 - DNA, 14 bp, Artificial Sequence
  Antisense nucleotide
ctccaaatgtaggg

SEQ ID NO: 2065 - DNA, 14 bp, Artificial Sequence
  Antisense nucleotide
accttgctgtactg

SEQ ID NO: 2066 - DNA, 14 bp, Artificial Sequence
  Antisense nucleotide
gtagtacacgatgg

SEQ ID NO: 2067 - DNA, 14 bp, Artificial Sequence
  Antisense nucleotide
cacgtagtacacga

SEQ ID NO: 2068 - DNA, 14 bp, Artificial Sequence
  Antisense nucleotide
catgttggacagct

SEQ ID NO: 2069 - DNA, 14 bp, Artificial Sequence
  Antisense nucleotide
gcacgatcatgttg

SEQ ID NO: 2070 - DNA, 16 bp, Artificial Sequence
  Antisense nucleotide
tgtactctgcttgaac

SEQ ID NO: 2071 - DNA, 16 bp, Artificial Sequence
  Antisense nucleotide
ctctgatgtgttgaag

SEQ ID NO: 2072 - DNA, 16 bp, Artificial Sequence
  Antisense nucleotide
ggaagtcaatgtacag

SEQ ID NO: 2073 - DNA, 18 bp, Artificial Sequence
  Antisense nucleotide
catgtcgatagtcttgca

SEQ ID NO: 2074 - DNA, 18 bp, Artificial Sequence
  Antisense nucleotide
agctgaagcaatagttgg

SEQ ID NO: 2075 - DNA, 18 bp, Artificial Sequence
  Antisense nucleotide
gtcatagatttcgttgtg

SEQ ID NO: 2076 - DNA, 18 bp, Artificial Sequence
  Antisense nucleotide
ctccacttttaacttgag

SEQ ID NO: 2077 - DNA, 18 bp, Artificial Sequence
  Antisense nucleotide
tgctgtatttctggtaca

SEQ ID NO: 2078 - DNA, 14 bp, Artificial Sequence
  Antisense nucleotide
tcgagcttccccca

SEQ ID NO: 2079 - DNA, 14 bp, Artificial Sequence
  Antisense nucleotide
ccccgagcccaagg

SEQ ID NO: 2080 - DNA, 13 bp, Artificial Sequence
  Antisense nucleotide
cccgacgagccgg

SEQ ID NO: 2081 - DNA, 14 bp, Artificial Sequence
  Antisense nucleotide
acgcaccaaggcga

SEQ ID NO: 2082 - DNA, 15 bp, Artificial Sequence
  Antisense nucleotide
cgggttgtcgagccc

SEQ ID NO: 2083 - DNA, 13 bp, Artificial Sequence
  Antisense nucleotide
cggcagtgccccg

SEQ ID NO: 2084 - DNA, 14 bp, Artificial Sequence
  Antisense nucleotide
cgcaattctgctcg

SEQ ID NO: 2085 - DNA, 14 bp, Artificial Sequence
  Antisense nucleotide
ttcgttgtgctccc

SEQ ID NO: 2086 - DNA, 14 bp, Artificial Sequence
  Antisense nucleotide
attccgactcggtg

SEQ ID NO: 2087 - DNA, 17 bp, Artificial Sequence
  Antisense nucleotide
acgtgcgtcatcaccgt

SEQ ID NO: 2088 - DNA, 10 bp, Artificial Sequence
  Antisense nucleotide
ccaagaagcc

SEQ ID NO: 2089 - DNA, 14 bp, Artificial Sequence
  Antisense nucleotide
cctaatgccttcca

SEQ ID NO: 2090 - DNA, 14 bp, Artificial Sequence
  Antisense nucleotide
tcagcagggccagg

SEQ ID NO: 2091 - DNA, 17 bp, Artificial Sequence
  Antisense nucleotide
gcaaagttcagcagggc

SEQ ID NO: 2092 - DNA, 16 bp, Artificial Sequence
  Antisense nucleotide
ggcaaagttcagcagg

SEQ ID NO: 2093 - DNA, 18 bp, Artificial Sequence
  Antisense nucleotide
gtggcaaagttcagcagg

SEQ ID NO: 2094 - DNA, 14 bp, Artificial Sequence
  Antisense nucleotide
gtggcaaagttcag

SEQ ID NO: 2095 - DNA, 18 bp, Artificial Sequence
  Antisense nucleotide
gaccgtggcaaagttcag

SEQ ID NO: 2096 - DNA, 15 bp, Artificial Sequence
  Antisense nucleotide
agagaggctgaccgt

SEQ ID NO: 2097 - DNA, 17 bp, Artificial Sequence
  Antisense nucleotide
gagagagagaggctgac

SEQ ID NO: 2098 - DNA, 15 bp, Artificial Sequence
  Antisense nucleotide
acagagagaggctga

SEQ ID NO: 2099 - DNA, 15 bp, Artificial Sequence
  Antisense nucleotide
gtggacagagagagg

SEQ ID NO: 2100 - DNA, 18 bp, Artificial Sequence
  Antisense nucleotide
caactggacagagagagg

SEQ ID NO: 2101 - DNA, 16 bp, Artificial Sequence
  Antisense nucleotide
tcttcttgatgtggcc

SEQ ID NO: 2102 - DNA, 17 bp, Artificial Sequence
  Antisense nucleotide
ccctcttcttcttgatg

SEQ ID NO: 2103 - DNA, 14 bp, Artificial Sequence
  Antisense nucleotide
caccctcttcttct

SEQ ID NO: 2104 - DNA, 17 bp, Artificial Sequence
  Antisense nucleotide
atggatttctttggcat

SEQ ID NO: 2105 - DNA, 13 bp, Artificial Sequence
  Antisense nucleotide
ggatttctttggc

SEQ ID NO: 2106 - DNA, 18 bp, Artificial Sequence
  Antisense nucleotide
aagttggactctcttctc

SEQ ID NO: 2107 - DNA, 18 bp, Artificial Sequence
  Antisense nucleotide
taagttggactctcttct

SEQ ID NO: 2108 - DNA, 16 bp, Artificial Sequence
  Antisense nucleotide
taggagtggttgaggc

SEQ ID NO: 2109 - DNA, 17 bp, Artificial Sequence
  Antisense nucleotide
gtgtaggagtggttgag

SEQ ID NO: 2110 - DNA, 14 bp, Artificial Sequence
  Antisense nucleotide
ctgtgtaggagtgg

SEQ ID NO: 2111 - DNA, 14 bp, Artificial Sequence
  Antisense nucleotide
cccacatgcctgtg

SEQ ID NO: 2112 - DNA, 14 bp, Artificial Sequence
  Antisense nucleotide
cgatgaacaacgag

SEQ ID NO: 2113 - DNA, 16 bp, Artificial Sequence
  Antisense nucleotide
ctggcgatgaacaacg

SEQ ID NO: 2114 - DNA, 14 bp, Artificial Sequence
  Antisense nucleotide
cgctggcgatgaac

SEQ ID NO: 2115 - DNA, 15 bp, Artificial Sequence
  Antisense nucleotide
gagctagtcccgttg

SEQ ID NO: 2116 - DNA, 15 bp, Artificial Sequence
  Antisense nucleotide
gcgaagagctagtcc

SEQ ID NO: 2117 - DNA, 17 bp, Artificial Sequence
  Antisense nucleotide
ccagttatgcgaagagc

SEQ ID NO: 2118 - DNA, 16 bp, Artificial Sequence
  Antisense nucleotide
ccccagttatgcgaag

SEQ ID NO: 2119 - DNA, 14 bp, Artificial Sequence
  Antisense nucleotide
cggccgcggtgtgt

SEQ ID NO: 2120 - DNA, 17 bp, Artificial Sequence
  Antisense nucleotide
cgggaatgcttccgccg

SEQ ID NO: 2121 - DNA, 17 bp, Artificial Sequence
  Antisense nucleotide
cggctcaccgcctcggc

SEQ ID NO: 2122 - DNA, 14 bp, Artificial Sequence
  Antisense nucleotide
cacgtctgcggatc

SEQ ID NO: 2123 - DNA, 18 bp, Artificial Sequence
  Antisense nucleotide
ccccgcatcgcatcaggg

SEQ ID NO: 2124 - DNA, 14 bp, Artificial Sequence
  Antisense nucleotide
cgccttgcaacgcg

SEQ ID NO: 2125 - DNA, 14 bp, Artificial Sequence
  Antisense nucleotide
ccgaccggggccgg

SEQ ID NO: 2126 - DNA, 14 bp, Artificial Sequence
  Antisense nucleotide
gttcatggtttcgg

SEQ ID NO: 2127 - DNA, 15 bp, Artificial Sequence
  Antisense nucleotide
gcagaaagttcatgg

SEQ ID NO: 2128 - DNA, 14 bp, Artificial Sequence
  Antisense nucleotide
gctgatagacatcc

SEQ ID NO: 2129 - DNA, 14 bp, Artificial Sequence
  Antisense nucleotide
gcgctgatagacat

SEQ ID NO: 2130 - DNA, 16 bp, Artificial Sequence
  Antisense nucleotide
gtagctgcgctgatag

SEQ ID NO: 2131 - DNA, 14 bp, Artificial Sequence
  Antisense nucleotide
ctcgatctcatcag

SEQ ID NO: 2132 - DNA, 17 bp, Artificial Sequence
  Antisense nucleotide
atgtactcgatctcatc

SEQ ID NO: 2133 - DNA, 16 bp, Artificial Sequence
  Antisense nucleotide
gaagatgtactcgatc

SEQ ID NO: 2134 - DNA, 16 bp, Artificial Sequence
  Antisense nucleotide
cttgaagatgtactcg

SEQ ID NO: 2135 - DNA, 14 bp, Artificial Sequence
  Antisense nucleotide
gcatcgcatcaggg

SEQ ID NO: 2136 - DNA, 14 bp, Artificial Sequence
  Antisense nucleotide
ccgcatcgcatcag

SEQ ID NO: 2137 - DNA, 18 bp, Artificial Sequence
  Antisense nucleotide
catttgttgtgctgtagg

SEQ ID NO: 2138 - DNA, 18 bp, Artificial Sequence
  Antisense nucleotide
ggtctgcattcacatttg

SEQ ID NO: 2139 - DNA, 15 bp, Artificial Sequence
  Antisense nucleotide
ctttggtctgcattc

SEQ ID NO: 2140 - DNA, 15 bp, Artificial Sequence
  Antisense nucleotide
ctttctttggtctgc

SEQ ID NO: 2141 - DNA, 17 bp, Artificial Sequence
  Antisense nucleotide
gctctatctttctttgg

SEQ ID NO: 2142 - DNA, 17 bp, Artificial Sequence
  Antisense nucleotide
gtcttgctctatctttc

SEQ ID NO: 2143 - DNA, 16 bp, Artificial Sequence
  Antisense nucleotide
cttgtcttgctctatc

SEQ ID NO: 2144 - DNA, 18 bp, Artificial Sequence
  Antisense nucleotide
catctgcaagtacgttcg

SEQ ID NO: 2145 - DNA, 18 bp, Artificial Sequence
  Antisense nucleotide
cacatctgcaagtacgtt

SEQ ID NO: 2146 - DNA, 18 bp, Artificial Sequence
  Antisense nucleotide
gtcacatctgcaagtacg

SEQ ID NO: 2147 - DNA, 14 bp, Artificial Sequence
  Antisense nucleotide
catctgcaagtacg

SEQ ID NO: 2148 - DNA, 15 bp, Artificial Sequence
  Antisense nucleotide
cacatctgcaagtac

SEQ ID NO: 2149 - DNA, 14 bp, Artificial Sequence
  Antisense nucleotide
gtcacatctgcaag

SEQ ID NO: 2150 - DNA, 14 bp, Artificial Sequence
  Antisense nucleotide
cttgtcacatctgc

SEQ ID NO: 2151 - DNA, 16 bp, Artificial Sequence
  Antisense nucleotide
ggcttgtcacatctgc

SEQ ID NO: 2152 - DNA, 16 bp, Artificial Sequence
  Antisense nucleotide
ctcggcttgtcacatc

SEQ ID NO: 2153 - DNA, 14 bp, Artificial Sequence
  Antisense nucleotide
ctccttcctcctgc

SEQ ID NO: 2154 - DNA, 18 bp, Artificial Sequence
  Antisense nucleotide
gcttgaagatgtacctcg

SEQ ID NO: 2155 - DNA, 15 bp, Artificial Sequence
  Antisense nucleotide
cgttgctctccgacg

SEQ ID NO: 2156 - DNA, 18 bp, Artificial Sequence
  Antisense nucleotide
cttcttttgcaagtctgt

SEQ ID NO: 2157 - DNA, 18 bp, Artificial Sequence
  Antisense nucleotide
tgagctgtgcatgccttc

SEQ ID NO: 2158 - DNA, 15 bp, Artificial Sequence
  Antisense nucleotide
agtcaggaggaccag

SEQ ID NO: 2159 - DNA, 15 bp, Artificial Sequence
  Antisense nucleotide
tgggtgccctggcct

SEQ ID NO: 2160 - DNA, 15 bp, Artificial Sequence
  Antisense nucleotide
catgttaggcaggtt

SEQ ID NO: 2161 - DNA, 17 bp, Artificial Sequence
  Antisense nucleotide
aggcatctcggagatct

SEQ ID NO: 2162 - DNA, 16 bp, Artificial Sequence
  Antisense nucleotide
aaagtcttcactctgc

SEQ ID NO: 2163 - DNA, 17 bp, Artificial Sequence
  Antisense nucleotide
aacaagttgtccagctg

SEQ ID NO: 2164 - DNA, 18 bp, Artificial Sequence
  Antisense nucleotide
gtaaaactggatcatctc

SEQ ID NO: 2165 - DNA, 15 bp, Artificial Sequence
  Antisense nucleotide
catcacctcctccag

SEQ ID NO: 2166 - DNA, 18 bp, Artificial Sequence
  Antisense nucleotide
gggtcttcaggttctccc

SEQ ID NO: 2167 - DNA, 18 bp, Artificial Sequence
  Antisense nucleotide
cacggccttgctcttgtt

SEQ ID NO: 2168 - DNA, 18 bp, Artificial Sequence
  Antisense nucleotide
ttattaaaggcattcttc

SEQ ID NO: 2169 - DNA, 18 bp, Artificial Sequence
  Antisense nucleotide
aagatgtcaaactcactc

SEQ ID NO: 2170 - DNA, 18 bp, Artificial Sequence
  Antisense nucleotide
gtagttgatgaagatgtc

SEQ ID NO: 2171 - DNA, 16 bp, Artificial Sequence
  Antisense nucleotide
gattttggagacctct

SEQ ID NO: 2172 - DNA, 16 bp, Artificial Sequence
  Antisense nucleotide
tcagctatcccagagc

SEQ ID NO: 2173 - DNA, 15 bp, Artificial Sequence
  Antisense nucleotide
ggctgggtcagctat

SEQ ID NO: 2174 - DNA, 18 bp, Artificial Sequence
  Antisense nucleotide
aaatcgttcacagagaag

SEQ ID NO: 2175 - DNA, 18 bp, Artificial Sequence
  Antisense nucleotide
tctttctaaatcgttcac

SEQ ID NO: 2176 - DNA, 14 bp, Artificial Sequence
  Antisense nucleotide
ttcatgtctgtgcc

SEQ ID NO: 2177 - DNA, 14 bp, Artificial Sequence
  Antisense nucleotide
gtaggtgagttcca

SEQ ID NO: 2178 - DNA, 14 bp, Artificial Sequence
  Antisense nucleotide
gttgtgagcgatga

SEQ ID NO: 2179 - DNA, 18 bp, Artificial Sequence
  Antisense nucleotide
catagttgtcctcaaaga

SEQ ID NO: 2180 - DNA, 14 bp, Artificial Sequence
  Antisense nucleotide
ggcatagttgtcct

SEQ ID NO: 2181 - DNA, 14 bp, Artificial Sequence
  Antisense nucleotide
cattgtctagcacg

SEQ ID NO: 2182 - DNA, 14 bp, Artificial Sequence
  Antisense nucleotide
ctccattgtctagc

SEQ ID NO: 2183 - DNA, 14 bp, Artificial Sequence
  Antisense nucleotide
gtattgttcagcgg

SEQ ID NO: 2184 - DNA, 16 bp, Artificial Sequence
  Antisense nucleotide
tcaagatctctgtgag

SEQ ID NO: 2185 - DNA, 16 bp, Artificial Sequence
  Antisense nucleotide
cacaaaatcgtgtcct

SEQ ID NO: 2186 - DNA, 16 bp, Artificial Sequence
  Antisense nucleotide
tccttccacaaaatcg

SEQ ID NO: 2187 - DNA, 14 bp, Artificial Sequence
  Antisense nucleotide
gtggaagatgtcct

SEQ ID NO: 2188 - DNA, 16 bp, Artificial Sequence
  Antisense nucleotide
tcttgtggaagatgtc

SEQ ID NO: 2189 - DNA, 16 bp, Artificial Sequence
  Antisense nucleotide
tctatcagtgtgagag

SEQ ID NO: 2190 - DNA, 14 bp, Artificial Sequence
  Antisense nucleotide
ggttggtgtctatc

SEQ ID NO: 2191 - DNA, 14 bp, Artificial Sequence
  Antisense nucleotide
acatcggagaacag

SEQ ID NO: 2192 - DNA, 14 bp, Artificial Sequence
  Antisense nucleotide
ccttacacatcgga

SEQ ID NO: 2193 - DNA, 16 bp, Artificial Sequence
  Antisense nucleotide
acaatcctcagaactc

SEQ ID NO: 2194 - DNA, 14 bp, Artificial Sequence
  Antisense nucleotide
gctctgacaatcct

SEQ ID NO: 2195 - DNA, 14 bp, Artificial Sequence
  Antisense nucleotide
tggttgaagtggag

SEQ ID NO: 2196 - DNA, 14 bp, Artificial Sequence
  Antisense nucleotide
ctgtggttgaagtg

SEQ ID NO: 2197 - DNA, 14 bp, Artificial Sequence
  Antisense nucleotide
gttgtaggtgacca

SEQ ID NO: 2198 - DNA, 14 bp, Artificial Sequence
  Antisense nucleotide
ctgtgttgtaggtg

SEQ ID NO: 2199 - DNA, 14 bp, Artificial Sequence
  Antisense nucleotide
gactcaaacgtgtc

SEQ ID NO: 2200 - DNA, 14 bp, Artificial Sequence
  Antisense nucleotide
catggactcaaacg

SEQ ID NO: 2201 - DNA, 14 bp, Artificial Sequence
  Antisense nucleotide
cgaatgtataccgg

SEQ ID NO: 2202 - DNA, 14 bp, Artificial Sequence
  Antisense nucleotide
ccgaatgtataccg

SEQ ID NO: 2203 - DNA, 14 bp, Artificial Sequence
  Antisense nucleotide
gccgaatgtatacc

SEQ ID NO: 2204 - DNA, 14 bp, Artificial Sequence
  Antisense nucleotide
gtagttgtagggac

SEQ ID NO: 2205 - DNA, 18 bp, Artificial Sequence
  Antisense nucleotide
tagaaaggtagttgtagg

SEQ ID NO: 2206 - DNA, 18 bp, Artificial Sequence
  Antisense nucleotide
gtagaaaggtagttgtag

SEQ ID NO: 2207 - DNA, 16 bp, Artificial Sequence
  Antisense nucleotide
cgtagaaaggtagttg

SEQ ID NO: 2208 - DNA, 14 bp, Artificial Sequence
  Antisense nucleotide
ccgtagaaaggtag

SEQ ID NO: 2209 - DNA, 14 bp, Artificial Sequence
  Antisense nucleotide
gaccatagcacact

SEQ ID NO: 2210 - DNA, 14 bp, Artificial Sequence
  Antisense nucleotide
ggatattggcactg

SEQ ID NO: 2211 - DNA, 14 bp, Artificial Sequence
  Antisense nucleotide
cctggatattggca

SEQ ID NO: 2212 - DNA, 14 bp, Artificial Sequence
  Antisense nucleotide
gctcccaaagatct

SEQ ID NO: 2213 - DNA, 14 bp, Artificial Sequence
  Antisense nucleotide
cccatcaaagctct

SEQ ID NO: 2214 - DNA, 14 bp, Artificial Sequence
  Antisense nucleotide
caaacacttggagc

SEQ ID NO: 2215 - DNA, 16 bp, Artificial Sequence
  Antisense nucleotide
gtctcaaacacttgga

SEQ ID NO: 2216 - DNA, 16 bp, Artificial Sequence
  Antisense nucleotide
gagtctcaaacacttg

SEQ ID NO: 2217 - DNA, 16 bp, Artificial Sequence
  Antisense nucleotide
gtaacctgtgatctct

SEQ ID NO: 2218 - DNA, 14 bp, Artificial Sequence
  Antisense nucleotide
ggtaacctgtgatc

SEQ ID NO: 2219 - DNA, 16 bp, Artificial Sequence
  Antisense nucleotide
gtataggtaacctgtg

SEQ ID NO: 2220 - DNA, 18 bp, Artificial Sequence
  Antisense nucleotide
tgagatgtataggtaacc

SEQ ID NO: 2221 - DNA, 16 bp, Artificial Sequence
  Antisense nucleotide
tgctgagatgtatagg

SEQ ID NO: 2222 - DNA, 14 bp, Artificial Sequence
  Antisense nucleotide
ccatgctgagatgt

SEQ ID NO: 2223 - DNA, 14 bp, Artificial Sequence
  Antisense nucleotide
ggattacttgcagg

SEQ ID NO: 2224 - DNA, 16 bp, Artificial Sequence
  Antisense nucleotide
tgttatggtggatgag

SEQ ID NO: 2225 - DNA, 14 bp, Artificial Sequence
  Antisense nucleotide
ggtgttatggtgga

SEQ ID NO: 2226 - DNA, 14 bp, Artificial Sequence
  Antisense nucleotide
gcagttgacacact

SEQ ID NO: 2227 - DNA, 14 bp, Artificial Sequence
  Antisense nucleotide
agtactcggcattc

SEQ ID NO: 2228 - DNA, 16 bp, Artificial Sequence
  Antisense nucleotide
cattcacatactccct

SEQ ID NO: 2229 - DNA, 16 bp, Artificial Sequence
  Antisense nucleotide
tccaaaacaggtcact

SEQ ID NO: 2230 - DNA, 14 bp, Artificial Sequence
  Antisense nucleotide
ggtccttatagtgg

SEQ ID NO: 2231 - DNA, 14 bp, Artificial Sequence
  Antisense nucleotide
cagaatgccaacca

SEQ ID NO: 2232 - DNA, 14 bp, Artificial Sequence
  Antisense nucleotide
acgagaatgccaac

SEQ ID NO: 2233 - DNA, 14 bp, Artificial Sequence
  Antisense nucleotide
gatcccaaagacca

SEQ ID NO: 2234 - DNA, 14 bp, Artificial Sequence
  Antisense nucleotide
tcgcttgatgagga

SEQ ID NO: 2235 - DNA, 14 bp, Artificial Sequence
  Antisense nucleotide
catcgtgtacttcc

SEQ ID NO: 2236 - DNA, 14 bp, Artificial Sequence
  Antisense nucleotide
gcatcgtgtacttc

SEQ ID NO: 2237 - DNA, 14 bp, Artificial Sequence
  Antisense nucleotide
actgtgccaaaagc

SEQ ID NO: 2238 - DNA, 14 bp, Artificial Sequence
  Antisense nucleotide
cttgtagactgtgc

SEQ ID NO: 2239 - DNA, 14 bp, Artificial Sequence
  Antisense nucleotide
cccttgtagactgt

SEQ ID NO: 2240 - DNA, 16 bp, Artificial Sequence
  Antisense nucleotide
tcaacactttgatggc

SEQ ID NO: 2241 - DNA, 14 bp, Artificial Sequence
  Antisense nucleotide
ccctcaacactttg

SEQ ID NO: 2242 - DNA, 16 bp, Artificial Sequence
  Antisense nucleotide
gtgttttccctcaaca

SEQ ID NO: 2243 - DNA, 16 bp, Artificial Sequence
  Antisense nucleotide
gtatgcttcgtctaag

SEQ ID NO: 2244 - DNA, 14 bp, Artificial Sequence
  Antisense nucleotide
cgtatgcttcgtct

SEQ ID NO: 2245 - DNA, 14 bp, Artificial Sequence
  Antisense nucleotide
ccatcacgtatgct

SEQ ID NO: 2246 - DNA, 14 bp, Artificial
  Antisense nucleotide
gcataagctgtgtc

SEQ ID NO: 2247 - DNA, 14 bp, Artificial
  Antisense nucleotide
catggtctaagagg

SEQ ID NO: 2248 - DNA, 16 bp, Artificial Sequence
  Antisense nucleotide
caatctgcatacacca

SEQ ID NO: 2249 - DNA, 14 bp, Artificial Sequence
  Antisense nucleotide
ggcaatctgcatac

SEQ ID NO: 2250 - DNA, 14 bp, Artificial Sequence
  Antisense nucleotide
ctgtctcgtcaatg

SEQ ID NO: 2251 - DNA, 16 bp, Artificial Sequence
  Antisense nucleotide
cataactccacacatc

SEQ ID NO: 2252 - DNA, 16 bp, Artificial Sequence
  Antisense nucleotide
agtcacaccataactc

SEQ ID NO: 2253 - DNA, 16 bp, Artificial Sequence
  Antisense nucleotide
acagtcacaccataac

SEQ ID NO: 2254 - DNA, 14 bp, Artificial Sequence
  Antisense nucleotide
ccccaaaagtcatc

SEQ ID NO: 2255 - DNA, 14 bp, Artificial Sequence
  Antisense nucleotide
tcgtaaggtttggc

SEQ ID NO: 2256 - DNA, 14 bp, Artificial Sequence
  Antisense nucleotide
gatcccatcgtaag

SEQ ID NO: 2257 - DNA, 14 bp, Artificial Sequence
  Antisense nucleotide
caatggtgcagatg

SEQ ID NO: 2258 - DNA, 14 bp, Artificial Sequence
  Antisense nucleotide
gacatcaatggtgc

SEQ ID NO: 2259 - DNA, 16 bp, Artificial Sequence
  Antisense nucleotide
gtagacatcaatggtg

SEQ ID NO: 2260 - DNA, 18 bp, Artificial Sequence
  Antisense nucleotide
catgatcatgtagacatc

SEQ ID NO: 2261 - DNA, 16 bp, Artificial Sequence
  Antisense nucleotide
ccatgatcatgtagac

SEQ ID NO: 2262 - DNA, 18 bp, Artificial Sequence
  Antisense nucleotide
catttgaccatgatcatg

SEQ ID NO: 2263 - DNA, 16 bp, Artificial Sequence
  Antisense nucleotide
ccaacatttgaccatg

SEQ ID NO: 2264 - DNA, 18 bp, Artificial Sequence
  Antisense nucleotide
tcatccaacatttgacca

SEQ ID NO: 2265 - DNA, 18 bp, Artificial Sequence
  Antisense nucleotide
gagtcaatcatccaacat

SEQ ID NO: 2266 - DNA, 16 bp, Artificial Sequence
  Antisense nucleotide
cagagtcaatcatcca

SEQ ID NO: 2267 - DNA, 14 bp, Artificial Sequence
  Antisense nucleotide
ccgacattcagagt

SEQ ID NO: 2268 - DNA, 16 bp, Artificial Sequence
  Antisense nucleotide
gaattcagacaccaac

SEQ ID NO: 2269 - DNA, 14 bp, Artificial Sequence
  Antisense nucleotide
gatgaccacaaagc

SEQ ID NO: 2270 - DNA, 16 bp, Artificial Sequence
  Antisense nucleotide
ccatcaaatacatcgg

SEQ ID NO: 2271 - DNA, 18 bp, Artificial Sequence
  Antisense nucleotide
tcaccatcaaatacatcg

SEQ ID NO: 2272 - DNA, 14 bp, Artificial Sequence
  Antisense nucleotide
caacgtagccatca

SEQ ID NO: 2273 - DNA, 14 bp, Artificial Sequence
  Antisense nucleotide
acgtctttgacgac

SEQ ID NO: 2274 - DNA, 18 bp, Artificial Sequence
  Antisense nucleotide
caaaaacgtctttgacga

SEQ ID NO: 2275 - DNA, 16 bp, Artificial Sequence
  Antisense nucleotide
ggcaaaaacgtctttg

SEQ ID NO: 2276 - DNA, 16 bp, Artificial Sequence
  Antisense nucleotide
caaaggcaaaaacgtc

SEQ ID NO: 2277 - DNA, 14 bp, Artificial Sequence
  Antisense nucleotide
gtgtcaagtactcg

SEQ ID NO: 2278 - DNA, 16 bp, Artificial Sequence
  Antisense nucleotide
gtaatagaggttgtcg

SEQ ID NO: 2279 - DNA, 14 bp, Artificial Sequence
  Antisense nucleotide
cccagtaatagagg

SEQ ID NO: 2280 - DNA, 14 bp, Artificial Sequence
  Antisense nucleotide
catggtgctcactg

SEQ ID NO: 2281 - DNA, 14 bp, Artificial Sequence
  Antisense nucleotide
gtgcctgtacgtac

SEQ ID NO: 2282 - DNA, 14 bp, Artificial Sequence
  Antisense nucleotide
tcggactatactgc

SEQ ID NO: 2283 - DNA, 16 bp, Artificial Sequence
  Antisense nucleotide
cagttcggactatact

SEQ ID NO: 2284 - DNA, 14 bp, Artificial Sequence
  Antisense nucleotide
aagcctaagacgca

SEQ ID NO: 2285 - DNA, 14 bp, Artificial Sequence
  Antisense nucleotide
gcccaagttcaaca

SEQ ID NO: 2286 - DNA, 14 bp, Artificial Sequence
  Antisense nucleotide
tgaaaagtcgcggt

SEQ ID NO: 2287 - DNA, 18 bp, Artificial Sequence
  Antisense nucleotide
ggttaattaagatgcctc

SEQ ID NO: 2288 - DNA, 14 bp, Artificial Sequence
  Antisense nucleotide
tctctaagagcgca

SEQ ID NO: 2289 - DNA, 16 bp, Artificial Sequence
  Antisense nucleotide
acgtgaggttagtttg

SEQ ID NO: 2290 - DNA, 14 bp, Artificial Sequence
  Antisense nucleotide
cacgtgaggttagt

SEQ ID NO: 2291 - DNA, 14 bp, Artificial Sequence
  Antisense nucleotide
catagaacagtccg

SEQ ID NO: 2292 - DNA, 16 bp, Artificial Sequence
  Antisense nucleotide
cagtcatagaacagtc

SEQ ID NO: 2293 - DNA, 18 bp, Artificial Sequence
  Antisense nucleotide
ctttgcagtcatagaaca

SEQ ID NO: 2294 - DNA, 14 bp, Artificial Sequence
  Antisense nucleotide
tgcagtcatagaac

SEQ ID NO: 2295 - DNA, 14 bp, Artificial Sequence
  Antisense nucleotide
ggtcgtttccatct

SEQ ID NO: 2296 - DNA, 16 bp, Artificial Sequence
  Antisense nucleotide
catagaaggtcgtttc

SEQ ID NO: 2297 - DNA, 14 bp, Artificial Sequence
  Antisense nucleotide
cgtcatagaaggtc

SEQ ID NO: 2298 - DNA, 15 bp, Artificial Sequence
  Antisense nucleotide
catcgtcatagaagg

SEQ ID NO: 2299 - DNA, 24 bp, Artificial Sequence
  Antisense nucleotide
ggacgggaggaacgaggcgttgag

SEQ ID NO: 2300 - DNA, 14 bp, Artificial Sequence
  Antisense nucleotide
tagccataaggtcc

SEQ ID NO: 2301 - DNA, 14 bp, Artificial Sequence
  Antisense nucleotide
ggttactgtagcca

SEQ ID NO: 2302 - DNA, 14 bp, Artificial Sequence
  Antisense nucleotide
ggttactgtagcca

SEQ ID NO: 2303 - DNA, 30 bp, Artificial Sequence
  Antisense nucleotide
cagggtcatgctctgtttcaggatcttggg

SEQ ID NO: 2304 - DNA, 18 bp, Artificial Sequence
  Antisense nucleotide
agttcttggcgcggaggt

SEQ ID NO: 2305 - DNA, 18 bp, Artificial Sequence
  Antisense nucleotide
aggtgaggaggtccgagt

SEQ ID NO: 2306 - DNA, 16 bp, Artificial Sequence
  Antisense nucleotide
tggactggattatcag

SEQ ID NO: 2307 - DNA, 18 bp, Artificial Sequence
  Antisense nucleotide
gtggtggtgatgtgcccg

SEQ ID NO: 2308 - DNA, 14 bp, Artificial Sequence
  Antisense nucleotide
tgtcacgttcttgg

SEQ ID NO: 2309 - DNA, 14 bp, Artificial Sequence
  Antisense nucleotide
ctcatctgtcacgt

SEQ ID NO: 2310 - DNA, 18 bp, Artificial Sequence
  Antisense nucleotide
cgaagccctcggcgaacc

SEQ ID NO: 2311 - DNA, 24 bp, Artificial Sequence
  Antisense nucleotide
gcgtgttctggctgtgcagttcgg

SEQ ID NO: 2312 - DNA, 14 bp, Artificial Sequence
  Antisense nucleotide
ctgccccgttgacc

SEQ ID NO: 2313 - DNA, 14 bp, Artificial Sequence
  Antisense nucleotide
aggtttgcgtagac

SEQ ID NO: 2314 - DNA, 14 bp, Artificial Sequence
  Antisense nucleotide
ggttgaagttgctg

SEQ ID NO: 2315 - DNA, 14 bp, Artificial Sequence
  Antisense nucleotide
ctgggttgaagttg

SEQ ID NO: 2316 - DNA, 24 bp, Artificial Sequence
  Antisense nucleotide
tgctggggttgcgcgggaaaggcc

SEQ ID NO: 2317 - DNA, 20 bp, Artificial Sequence
  Antisense nucleotide
tgctgcacgggcatctgctg

SEQ ID NO: 2318 - DNA, 27 bp, Artificial Sequence
  Antisense nucleotide
ggcactgtctgaggctcctccttcagg

SEQ ID NO: 2319 - DNA, 14 bp, Artificial Sequence
  Antisense nucleotide
actccatgtcgatg

SEQ ID NO: 2320 - DNA, 16 bp, Artificial Sequence
  Antisense nucleotide
ctctccgccttgatcc

SEQ ID NO: 2321 - DNA, 16 bp, Artificial Sequence
  Antisense nucleotide
gttcctcatgcgcttc

SEQ ID NO: 2322 - DNA, 14 bp, Artificial Sequence
  Antisense nucleotide
ctgagctttcaagg

SEQ ID NO: 2323 - DNA, 26 bp, Artificial Sequence
  Antisense nucleotide
gcgattctctccagcttcctttttcg

SEQ ID NO: 2324 - DNA, 30 bp, Artificial Sequence; identical to SEQ ID NO: 1131
  Antisense nucleotide

SEQ ID NO: 2325 - DNA, 14 bp, Artificial Sequence
  Antisense nucleotide
tccctgagcatgtt

SEQ ID NO: 2326 - DNA, 16 bp, Artificial Sequence
  Antisense nucleotide
tctgtttaagctgtgc

SEQ ID NO: 2327 - DNA, 18 bp, Artificial Sequence
  Antisense nucleotide
ctttctgtttaagctgtg

SEQ ID NO: 2328 - DNA, 16 bp, Artificial Sequence
  Antisense nucleotide
ggttcatgactttctg

SEQ ID NO: 2329 - DNA, 14 bp, Artificial Sequence
  Antisense nucleotide
cgtggttcatgact

SEQ ID NO: 2330 - DNA, 16 bp, Artificial Sequence
  Antisense nucleotide
actgttaacgtggttc

SEQ ID NO: 2331 - DNA, 14 bp, Artificial Sequence
  Antisense nucleotide
ccactgttaacgtg

SEQ ID NO: 2332 - DNA, 14 bp, Artificial Sequence
  Antisense nucleotide
cccactgttaacgt

SEQ ID NO: 2333 - DNA, 14 bp, Artificial Sequence
  Antisense nucleotide
agcatgagttggca

SEQ ID NO: 2334 - DNA, 14 bp, Artificial Sequence
  Antisense nucleotide
gcgttagcatgagt

SEQ ID NO: 2335 - DNA, 14 bp, Artificial Sequence
  Antisense nucleotide
gtttgcaactgctg

SEQ ID NO: 2336 - DNA, 18 bp, Artificial Sequence
  Antisense nucleotide
caaaatgtttgcaactgc

SEQ ID NO: 2337 - DNA, 14 bp, Artificial Sequence
  Antisense nucleotide
tcgtagaaggtcgt

SEQ ID NO: 2338 - DNA, 14 bp, Artificial Sequence
  Antisense nucleotide
agggttactgtagc

SEQ ID NO: 2339 - DNA, 14 bp, Artificial Sequence
  Antisense nucleotide
gtagtggtgatgtg

SEQ ID NO: 2340 - DNA, 14 bp, Artificial Sequence
  Antisense nucleotide
cgtcgtagaaggtc

SEQ ID NO: 2341 - DNA, 14 bp, Artificial Sequence
  Antisense nucleotide
cgagaacatcatcg

SEQ ID NO: 2342 - DNA, 14 bp, Artificial Sequence
  Antisense nucleotide
gtagtctgcgttga

SEQ ID NO: 2343 - DNA, 20 bp, Artificial Sequence
  Antisense nucleotide
gctgcagcgggaggatgacg

SEQ ID NO: 2344 - DNA, 16 bp, Artificial Sequence
  Antisense nucleotide
agtaagagaggctatc

SEQ ID NO: 2345 - DNA, 14 bp, Artificial Sequence
  Antisense nucleotide
gtagtaagagaggc

SEQ ID NO: 2346 - DNA, 14 bp, Artificial Sequence
  Antisense nucleotide
ggtagtaagagagg

SEQ ID NO: 2347 - DNA, 16 bp, Artificial Sequence
  Antisense nucleotide
gtgagtggtagtaaga

SEQ ID NO: 2348 - DNA, 18 bp, Artificial Sequence
  Antisense nucleotide
gtccgtgcagaagtcctg

SEQ ID NO: 2349 - DNA, 16 bp, Artificial Sequence
  Antisense nucleotide
gaatgaagttggcact

SEQ ID NO: 2350 - DNA, 14 bp, Artificial Sequence
  Antisense nucleotide
ggaatgaagttggc

SEQ ID NO: 2351 - DNA, 14 bp, Artificial Sequence
  Antisense nucleotide
gggaatgaagttgg

SEQ ID NO: 2352 - DNA, 30 bp, Artificial Sequence; identical to SEQ ID NO: 1194
  Antisense nucleotide

SEQ ID NO: 2353 - DNA, 30 bp, Artificial Sequence
  Antisense nucleotide
ctggtctgcgatggggccacagaggagacg

SEQ ID NO: 2354 - DNA, 16 bp, Artificial Sequence
  Antisense nucleotide
tcatggtcttcacaac

SEQ ID NO: 2355 - DNA, 30 bp, Artificial Sequence; identical to SEQ ID NO: 1196
  Antisense nucleotide

SEQ ID NO: 2356 - DNA, 14 bp, Artificial Sequence
  Antisense nucleotide
ctagagttcctcac

SEQ ID NO: 2357 - DNA, 14 bp, Artificial Sequence
  Antisense nucleotide
gagtacgctagagt

SEQ ID NO: 2358 - DNA, 14 bp, Artificial Sequence
  Antisense nucleotide
gaagagtacgctag

SEQ ID NO: 2359 - DNA, 28 bp, Artificial Sequence
  Antisense nucleotide
ctgcttcccacccagcccccacattccc

SEQ ID NO: 2360 - DNA, 20 bp, Artificial Sequence
  Antisense nucleotide
ttcatcctctgtactgggct

SEQ ID NO: 2361 - DNA, 14 bp, Artificial Sequence
  Antisense nucleotide
gttacggatgtgca

SEQ ID NO: 2362 - DNA, 14 bp, Artificial Sequence
  Antisense nucleotide
cagttacggatgtg

SEQ ID NO: 2363 - DNA, 14 bp, Artificial Sequence
  Antisense nucleotide
ccagttacggatgt

SEQ ID NO: 2364 - DNA, 14 bp, Artificial Sequence
  Antisense nucleotide
agagtctgagttgg

SEQ ID NO: 2365 - DNA, 14 bp, Artificial Sequence
  Antisense nucleotide
gtgagactcagagt

SEQ ID NO: 2366 - DNA, 14 bp, Artificial Sequence
  Antisense nucleotide
tcttagggtgagac

SEQ ID NO: 2367 - DNA, 15 bp, Artificial Sequence
  Antisense nucleotide
agagtacttcttagg

SEQ ID NO: 2368 - DNA, 18 bp, Artificial Sequence
  Antisense nucleotide
ggaagaaactatgagagt

SEQ ID NO: 2369 - DNA, 18 bp, Artificial Sequence
  Antisense nucleotide
cttagggaagaaactatg

SEQ ID NO: 2370 - DNA, 16 bp, Artificial Sequence
  Antisense nucleotide
cggtaagaaacttagg

SEQ ID NO: 2371 - DNA, 14 bp, Artificial Sequence
  Antisense nucleotide
agcatgcggtaaga

SEQ ID NO: 2372 - DNA, 14 bp, Artificial Sequence
  Antisense nucleotide
gtctgaaagcatgc

SEQ ID NO: 2373 - DNA, 16 bp, Artificial Sequence
  Antisense nucleotide
agaacaaagaagagcc

SEQ ID NO: 2374 - DNA, 18 bp, Artificial Sequence
  Antisense nucleotide
caagagaacaaagaagag

SEQ ID NO: 2375 - DNA, 16 bp, Artificial Sequence
  Antisense nucleotide
cagcaagagaacaaag

SEQ ID NO: 2376 - DNA, 14 bp, Artificial Sequence
  Antisense nucleotide
tcctcagcaagaga

SEQ ID NO: 2377 - DNA, 14 bp, Artificial Sequence
  Antisense nucleotide
aggtgtgacttgca

SEQ ID NO: 2378 - DNA, 16 bp, Artificial Sequence
  Antisense nucleotide
gaataggtgtgacttg

SEQ ID NO: 2379 - DNA, 16 bp, Artificial Sequence
  Antisense nucleotide
cagaataggtgtgact

SEQ ID NO: 2380 - DNA, 14 bp, Artificial Sequence
  Antisense nucleotide
gcagaataggtgtg

SEQ ID NO: 2381 - DNA, 16 bp, Artificial Sequence
  Antisense nucleotide
cagttgcagaataggt

SEQ ID NO: 2382 - DNA, 16 bp, Artificial Sequence
  Antisense nucleotide
gaaaccatttctgacc

SEQ ID NO: 2383 - DNA, 18 bp, Artificial Sequence
  Antisense nucleotide
tgtgaaaccatttctgac

SEQ ID NO: 2384 - DNA, 18 bp, Artificial Sequence
  Antisense nucleotide
cactgtgaaaccatttct

SEQ ID NO: 2385 - DNA, 14 bp, Artificial Sequence
  Antisense nucleotide
ccactgtgaaacca

SEQ ID NO: 2386 - DNA, 30 bp, Artificial Sequence; identical to SEQ ID NO: 1227
  Antisense nucleotide

SEQ ID NO: 2387 - DNA, 15 bp, Artificial Sequence
  Antisense nucleotide
cacctccattcaccc

SEQ ID NO: 2388 - DNA, 16 bp, Artificial Sequence
  Antisense nucleotide
cagtaaaagtgtctgc

SEQ ID NO: 2389 - DNA, 18 bp, Artificial Sequence
  Antisense nucleotide
cgacattcagtaaaagtg

SEQ ID NO: 2390 - DNA, 14 bp, Artificial Sequence
  Antisense nucleotide
gaccgacattcagt

SEQ ID NO: 2391 - DNA, 18 bp, Artificial Sequence
  Antisense nucleotide
cttctggagataactaga

SEQ ID NO: 2392 - DNA, 18 bp, Artificial Sequence
  Antisense nucleotide
catcttattcctttccct

SEQ ID NO: 2393 - DNA, 16 bp, Artificial Sequence
  Antisense nucleotide
cagccatcttattcct

SEQ ID NO: 2394 - DNA, 16 bp, Artificial Sequence
  Antisense nucleotide
tgcagccatcttattc

SEQ ID NO: 2395 - DNA, 15 bp, Artificial Sequence
  Antisense nucleotide
gagtgtatcagtcag

SEQ ID NO: 2396 - DNA, 14 bp, Artificial Sequence
  Antisense nucleotide
ggagtgtatcagtc

SEQ ID NO: 2397 - DNA, 16 bp, Artificial Sequence
  Antisense nucleotide
cttggagtgtatcagt

SEQ ID NO: 2398 - DNA, 14 bp, Artificial Sequence
  Antisense nucleotide
acagagtacctacc

SEQ ID NO: 2399 - DNA, 16 bp, Artificial Sequence
  Antisense nucleotide
ccaactttcccttaag

SEQ ID NO: 2400 - DNA, 16 bp, Artificial Sequence
  Antisense nucleotide
ccttatgctcaatctc

SEQ ID NO: 2401 - DNA, 14 bp, Artificial Sequence
  Antisense nucleotide
gtcttactcaaggg

SEQ ID NO: 2402 - DNA, 16 bp, Artificial Sequence
  Antisense nucleotide
acagtcttactcaagg

SEQ ID NO: 2403 - DNA, 18 bp, Artificial Sequence
  Antisense nucleotide
cataagacacagtcttac

SEQ ID NO: 2404 - DNA, 18 bp, Artificial Sequence
  Antisense nucleotide
gaaagcataagacacagt

SEQ ID NO: 2405 - DNA, 16 bp, Artificial Sequence
  Antisense nucleotide
ggaaagcataagacac

SEQ ID NO: 2406 - DNA, 16 bp, Artificial Sequence
  Antisense nucleotide
agggataaaggaaagc

SEQ ID NO: 2407 - DNA, 14 bp, Artificial Sequence
  Antisense nucleotide
cctgtatacagagg

SEQ ID NO: 2408 - DNA, 16 bp, Artificial Sequence
  Antisense nucleotide
tgtctcctgtatacag

SEQ ID NO: 2409 - DNA, 16 bp, Artificial Sequence
  Antisense nucleotide
catcttctagttggtc

SEQ ID NO: 2410 - DNA, 16 bp, Artificial Sequence
  Antisense nucleotide
ctcatcttctagttgg

SEQ ID NO: 2411 - DNA, 18 bp, Artificial Sequence
  Antisense nucleotide
cttctcatcttctagttg

SEQ ID NO: 2412 - DNA, 16 bp, Artificial Sequence
  Antisense nucleotide
caaagcagacttctca

SEQ ID NO: 2413 - DNA, 14 bp, Artificial Sequence
  Antisense nucleotide
ctgcaaagcagact

SEQ ID NO: 2414 - DNA, 18 bp, Artificial Sequence
  Antisense nucleotide
ctagtttttccttctcct

SEQ ID NO: 2415 - DNA, 18 bp, Artificial Sequence
  Antisense nucleotide
tctagtttttccttctcc

SEQ ID NO: 2416 - DNA, 16 bp, Artificial Sequence
  Antisense nucleotide
caggatgaactctagt

SEQ ID NO: 2417 - DNA, 14 bp, Artificial Sequence
  Antisense nucleotide
cgagaacatcatgg

SEQ ID NO: 2418 - DNA, 14 bp, Artificial Sequence
  Antisense nucleotide
gtagtaggaaaggc

SEQ ID NO: 2419 - DNA, 14 bp, Artificial Sequence
  Antisense nucleotide
ggtagtaggaaagg

SEQ ID NO: 2420 - DNA, 14 bp, Artificial Sequence
  Antisense nucleotide
ggaatggtagtagg

SEQ ID NO: 2421 - DNA, 15 bp, Artificial Sequence
  Antisense nucleotide
ggtcattgagaagag

SEQ ID NO: 2422 - DNA, 16 bp, Artificial Sequence
  Antisense nucleotide
gctaatgttcttgacc

SEQ ID NO: 2423 - DNA, 15 bp, Artificial Sequence
  Antisense nucleotide
gtcaggaatcggcag

SEQ ID NO: 2424 - DNA, 16 bp, Artificial Sequence
  Antisense nucleotide
cttggagaagacatac

SEQ ID NO: 2425 - DNA, 14 bp, Artificial Sequence
  Antisense nucleotide
tgcctccccagaag

SEQ ID NO: 2426 - DNA, 17 bp, Artificial Sequence
  Antisense nucleotide
cactggcagtagaaatc

SEQ ID NO: 2427 - DNA, 15 bp, Artificial Sequence
  Antisense nucleotide
gctcactggcagtag

SEQ ID NO: 2428 - DNA, 14 bp, Artificial Sequence
  Antisense nucleotide
atggtcaggaatcg

SEQ ID NO: 2429 - DNA, 16 bp, Artificial Sequence
  Antisense nucleotide
gaatggtcaggaatcg

SEQ ID NO: 2430 - DNA, 14 bp, Artificial Sequence
  Antisense nucleotide
catcgtggactgtg

SEQ ID NO: 2431 - DNA, 14 bp, Artificial Sequence
  Antisense nucleotide
agccatggagatag

SEQ ID NO: 2432 - DNA, 15 bp, Artificial Sequence
  Antisense nucleotide
cagccatggagatag

SEQ ID NO: 2433 - DNA, 16 bp, Artificial Sequence
  Antisense nucleotide
acagccatggagatag

SEQ ID NO: 2434 - DNA, 17 bp, Artificial Sequence
  Antisense nucleotide
cacagccatggagatag

SEQ ID NO: 2435 - DNA, 16 bp, Artificial Sequence
  Antisense nucleotide
ccacagccatggagat

SEQ ID NO: 2436 - DNA, 14 bp, Artificial Sequence
  Antisense nucleotide
gccatggagatagg

SEQ ID NO: 2437 - DNA, 15 bp, Artificial Sequence
  Antisense nucleotide
agccatggagatagg

SEQ ID NO: 2438 - DNA, 16 bp, Artificial Sequence
  Antisense nucleotide
cagccatggagatagg

SEQ ID NO: 2439 - DNA, 17 bp, Artificial Sequence
  Antisense nucleotide
acagccatggagatagg

SEQ ID NO: 2440 - DNA, 14 bp, Artificial Sequence
  Antisense nucleotide
catggagatagggt

SEQ ID NO: 2441 - DNA, 15 bp, Artificial Sequence
  Antisense nucleotide
catggagatagggtg

SEQ ID NO: 2442 - DNA, 16 bp, Artificial Sequence
  Antisense nucleotide
catggagatagggtgg

SEQ ID NO: 2443 - DNA, 14 bp, Artificial Sequence
  Antisense nucleotide
atggagatagggtg

SEQ ID NO: 2444 - DNA, 15 bp, Artificial Sequence
  Antisense nucleotide
atggagatagggtgg

SEQ ID NO: 2445 - DNA, 16 bp, Artificial Sequence
  Antisense nucleotide
atggagatagggtggc

SEQ ID NO: 2446 - DNA, 17 bp, Artificial Sequence
  Antisense nucleotide
atggagatagggtggct

SEQ ID NO: 2447 - DNA, 14 bp, Artificial Sequence
  Antisense nucleotide
ggagatagggtggc

SEQ ID NO: 2448 - DNA, 15 bp, Artificial Sequence
  Antisense nucleotide
ggagatagggtggct

SEQ ID NO: 2449 - DNA, 14 bp, Artificial Sequence
  Antisense nucleotide
gaaatagcccaggc

SEQ ID NO: 2450 - DNA, 15 bp, Artificial Sequence
  Antisense nucleotide
gaaatagcccaggcg

SEQ ID NO: 2451 - DNA, 17 bp, Artificial Sequence
  Antisense nucleotide
gaaatagcccaggcgag

SEQ ID NO: 2452 - DNA, 14 bp, Artificial Sequence
  Antisense nucleotide
ggaaatagcccagg

SEQ ID NO: 2453 - DNA, 15 bp, Artificial Sequence
  Antisense nucleotide
ggaaatagcccaggc

SEQ ID NO: 2454 - DNA, 14 bp, Artificial Sequence
  Antisense nucleotide
gtcttcacatcgac

SEQ ID NO: 2455 - DNA, 15 bp, Artificial Sequence
  Antisense nucleotide
gtcttcacatcgact

SEQ ID NO: 2456 - DNA, 16 bp, Artificial Sequence
  Antisense nucleotide
gtcttcacatcgactt

SEQ ID NO: 2457 - DNA, 17 bp, Artificial Sequence
  Antisense nucleotide
gtcttcacatcgacttt

SEQ ID NO: 2458 - DNA, 18 bp, Artificial Sequence
  Antisense nucleotide
gtcttcacatcgactttg

SEQ ID NO: 2459 - DNA, 18 bp, Artificial Sequence
  Antisense nucleotide
gtcttcacatcgactttg

SEQ ID NO: 2460 - DNA, 18 bp, Artificial Sequence
  Antisense nucleotide
ccatttgtctgtcttcac

SEQ ID NO: 2461 - DNA, 18 bp, Artificial Sequence
  Antisense nucleotide
attaccgtctaccctgat

SEQ ID NO: 2462 - protein, 17 aa, Artificial Sequence
  Penetratin
RQIKIWFQNRRMKWKKC

The invention claimed is:

1. A method for producing a modified oligonucleotide, wherein at least one polymer and/or a compound is covalently bound to the 5"-end or the 3"-end of the oligonucleotide via native ligation forming a native ligation site, with the proviso that the polymer and/or the compound is not a protein or peptide if only the 5"-end of the oligonucleotide is modified by binding of the polymer or compound via native ligation.

2. The method according to claim 1, wherein a further polymer and/or compound is bound to the native ligation site and/or the 3"-end of the 5"-end native ligation modified oligonucleotide, or to the ligation site and/or the 5"-end of the 3"-end native ligation modified oligonucleotide.

3. The method according to claim 1,
wherein the 5"-end or the 3"-end of the oligonucleotide is bound to a polymer and/or a compound via native ligation in a first step, the free 3"-end or the free 5"-end of the oligonucleotide is bound to a polymer and/or a compound in a second step, and the native ligation site is optionally bound to a polymer and/or a compound in a third step, or
wherein the 5"-end or the 3"-end of the oligonucleotide is bound to a polymer and/or a compound via native ligation in a first step, the native ligation site is bound to a polymer and/or a compound in a second step and the free 3"-end or the free 5"-end of the oligonucleotide is optionally bound to a polymer and/or a compound in a third step, or
wherein the 3"-end or the 5"-end of the oligonucleotide is bound to a polymer and/or a compound in a first step, the free 5"-end or the free 3"-end of the oligonucleotide is bound to a polymer and/or a compound via native ligation in a second step, and the ligation site is optionally bound to a polymer and/or a compound in a third step.

4. The method according to claim 1, wherein the modified oligonucleotide is a TGF-β2, TGF-β1, TGF-β3, VEGF, IL-10, c-jun, c-fos, c-erbb2 (Her-2), or MIA antisense oligonucleotide and/or an antisense oligonucleotide hybridizing with one or more of the receptors of TGF-β2, TGF-β1, TGF-β3, VEGF, IL-10, c-jun, c-fos, c-erbb2 (Her-2), or MIA.

5. The method according to claim 1, wherein the polymer is polyethylene glycol.

6. The method according to claim 1, wherein the compound is a small molecule, an antibody, an antigen, an enzyme, a part of an antibody, an enzyme, or any peptide.

7. The method according to claim 1, wherein the polymer and/or compound is bound to the oligonucleotide, with or without a linker.

8. The method according to claim 7, wherein the linker is a reversible or irreversible linker.

9. The method according to claim 1, wherein the modified oligonucleotide is bound to a solid support via the 5"- and/or 3"-end of the oligonucleotide and/or the ligation site.

10. The method according to claim 1, wherein the polymer is polyethylene glycol selected from PEG-400, PEG-1000, PEG-2000, PEG-5000, or PEG10000.

11. The method according to claim 1, wherein the compound is selected from an internalizing peptide, an aptamer, a spiegelmer, RNAi, shRNA, miRNA, a chromophor, a marker, biotin, a hormone, a signal peptide, a lipid, a fatty acid, a sugar, an amino acid, a receptor, a part of a receptor, or a ligand of a receptor or binding molecule.

* * * * *

UNITED STATES PATENT AND TRADEMARK OFFICE
CERTIFICATE OF CORRECTION

PATENT NO. : 8,936,910 B2  
APPLICATION NO. : 13/703260  
DATED : January 20, 2015  
INVENTOR(S) : Mitsch et al.

Page 1 of 1

It is certified that error appears in the above-identified patent and that said Letters Patent is hereby corrected as shown below:

In the Claims

Claim 1, Column 79, Line 17: "5"-end or the 3"-end" should read -- 5'-end or the 3'-end --
Claim 1, Column 79, Line 20: "5"-end" should read -- 5'-end --
Claim 2, Column 79, Line 24: "3"-end or the 5"-end" should read -- 5'-end or the 3'-end --
Claim 2, Column 79, Line 25: "5"-end" should read -- 5'-end --
Claim 2, Column 79, Line 26: "3"-end" should read -- 3'-end --
Claim 3, Column 79, Line 28: "5"-end or the 3"-end" should read -- 5'-end or the 3'-end --
Claim 3, Column 79, Line 30: "3"-end or the free 5"-end" should read -- 3'-end or the free 5'-end --
Claim 3, Column 79, Line 35: "5"-end or the 3"-end" should read -- 5'-end or the 3'-end --
Claim 3, Column 79, Line 39: "3"-end or the 5"-end" should read -- 3'-end or the 5'-end --
Claim 3, Column 79, Line 42: "3"-end or the 5"-end" should read -- 3'-end or the 5'-end --
Claim 3, Column 79, Line 44: "free 5"-end or the free 3"-end" should read -- free 5'-end or the free 3'-end --
Claim 9, Column 80, Line 34: "5"-and/or" should read -- 5'-and/or --
Claim 9, Column 80, Line 35: "3"-end" should read -- 3'-end --

Signed and Sealed this  
Fourteenth Day of April, 2015

Michelle K. Lee  
*Director of the United States Patent and Trademark Office*